United States Patent 10,787,518 (BISPECIFIC CHECKPOINT INHIBITOR ANTIBODIES) - sequence listing, part 3

SEQ ID NO: 29749 - protein, 218 aa, Artificial Sequence; identical to SEQ ID NO: 17590
  Description of Artificial Sequence: Synthetic polypeptide
  XENP020991 7G8_H0.60_L0_Fab Light Chain

SEQ ID NO: 29750 - protein, 111 aa, Artificial Sequence; identical to SEQ ID NO: 17591
  Description of Artificial Sequence: Synthetic polypeptide
  VL of XENP020991

SEQ ID NO: 29751 - protein, 15 aa, Artificial Sequence
  Description of Artificial Sequence: Synthetic peptide
  XENP020991 vlCDR1
KASQSVDYDGDSYMN

SEQ ID NO: 29752 - protein, 7 aa, Artificial Sequence
  Description of Artificial Sequence: Synthetic peptide
  XENP020991 vlCDR2
AASNLES

SEQ ID NO: 29753 - protein, 9 aa, Artificial Sequence
  Description of Artificial Sequence: Synthetic peptide
  XENP020991 vlCDR3
QQSNEDPFT

SEQ ID NO: 29754 - protein, 226 aa, Artificial Sequence
  Description of Artificial Sequence: Synthetic polypeptide
  XENP020992 7G8_H0.61_L0_Fab Heavy Chain
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29755 - protein, 121 aa, Artificial Sequence; identical to SEQ ID NO: 18816
  Description of Artificial Sequence: Synthetic polypeptide
  VH of XENP020992

SEQ ID NO: 29756 - protein, 5 aa, Artificial Sequence
  Description of Artificial Sequence: Synthetic peptide
  XENP020992 vhCDR1
DAWMD

SEQ ID NO: 29757 - protein, 19 aa, Artificial Sequence
  Description of Artificial Sequence: Synthetic peptide
  XENP020992 vhCDR2
EIRTKKNNHATYYAESVKG

SEQ ID NO: 29758 - protein, 10 aa, Artificial Sequence
  Description of Artificial Sequence: Synthetic peptide
  XENP020992 vhCDR3
LANWDWYFDV

SEQ ID NO: 29759 - protein, 218 aa, Artificial Sequence; identical to SEQ ID NO: 17590
  Description of Artificial Sequence: Synthetic polypeptide
  XENP020992 7G8_H0.61_L0_Fab Light Chain

SEQ ID NO: 29760 - protein, 111 aa, Artificial Sequence; identical to SEQ ID NO: 17591
  Description of Artificial Sequence: Synthetic polypeptide
  VL of XENP020992

SEQ ID NO: 29761 - protein, 15 aa, Artificial Sequence
  Description of Artificial Sequence: Synthetic peptide
  XENP020992 vlCDR1
KASQSVDYDGDSYMN

SEQ ID NO: 29762 - protein, 7 aa, Artificial Sequence
  Description of Artificial Sequence: Synthetic peptide
  XENP020992 vlCDR2
AASNLES

SEQ ID NO: 29763 - protein, 9 aa, Artificial Sequence
  Description of Artificial Sequence: Synthetic peptide
  XENP020992 vlCDR3
QQSNEDPFT

SEQ ID NO: 29764 - protein, 226 aa, Artificial Sequence
  Description of Artificial Sequence: Synthetic polypeptide
  XENP020993 7G8_H0.62_L0_Fab Heavy Chain
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29765 - protein, 121 aa, Artificial Sequence; identical to SEQ ID NO: 18826
  Description of Artificial Sequence: Synthetic polypeptide
  VH of XENP020993

SEQ ID NO: 29766 - protein, 5 aa, Artificial Sequence
  Description of Artificial Sequence: Synthetic peptide
  XENP020993 vhCDR1
DAWMD

SEQ ID NO: 29767 - protein, 19 aa, Artificial Sequence
  Description of Artificial Sequence: Synthetic peptide
  XENP020993 vhCDR2
EIRTKYNNHATYYAESVKG

SEQ ID NO: 29768 - protein, 10 aa, Artificial Sequence
  Description of Artificial Sequence: Synthetic peptide
  XENP020993 vhCDR3
LANWDWYFDV

SEQ ID NO: 29769 - protein, 218 aa, Artificial Sequence; identical to SEQ ID NO: 17590
  Description of Artificial Sequence: Synthetic polypeptide
  XENP020993 7G8_H0.62_L0_Fab Light Chain

SEQ ID NO: 29770 - protein, 111 aa, Artificial Sequence; identical to SEQ ID NO: 17591
  Description of Artificial Sequence: Synthetic polypeptide
  VL of XENP020993

SEQ ID NO: 29771 - protein, 15 aa, Artificial Sequence
  Description of Artificial Sequence: Synthetic peptide
  XENP020993 vlCDR1
KASQSVDYDGDSYMN

SEQ ID NO: 29772 - protein, 7 aa, Artificial Sequence
  Description of Artificial Sequence: Synthetic peptide
  XENP020993 vlCDR2
AASNLES

SEQ ID NO: 29773 - protein, 9 aa, Artificial Sequence
  Description of Artificial Sequence: Synthetic peptide
  XENP020993 vlCDR3
QQSNEDPFT

SEQ ID NO: 29774 - protein, 226 aa, Artificial Sequence
  Description of Artificial Sequence: Synthetic polypeptide
  XENP020994 7G8_H0.63_L0_Fab Heavy Chain
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29775 - protein, 121 aa, Artificial Sequence; identical to SEQ ID NO: 18836
  Description of Artificial Sequence: Synthetic polypeptide
  VH of XENP020994

SEQ ID NO: 29776 - protein, 5 aa, Artificial Sequence
  Description of Artificial Sequence: Synthetic peptide
  XENP020994 vhCDR1
DAWMD

SEQ ID NO: 29777 - protein, 19 aa, Artificial Sequence
  Description of Artificial Sequence: Synthetic peptide
  XENP020994 vhCDR2
EIRTKADNHATYYAESVKG

SEQ ID NO: 29778 - protein, 10 aa, Artificial Sequence
  Description of Artificial Sequence: Synthetic peptide
  XENP020994 vhCDR3
LANWDWYFDV

SEQ ID NO: 29779 - protein, 218 aa, Artificial Sequence; identical to SEQ ID NO: 17590
  Description of Artificial Sequence: Synthetic polypeptide
  XENP020994 7G8_H0.63_L0_Fab Light Chain

SEQ ID NO: 29780 - protein, 111 aa, Artificial Sequence; identical to SEQ ID NO: 17591
  Description of Artificial Sequence: Synthetic polypeptide
  VL of XENP020994

SEQ ID NO: 29781 - protein, 15 aa, Artificial Sequence
  Description of Artificial Sequence: Synthetic peptide
  XENP020994 vlCDR1
KASQSVDYDGDSYMN

SEQ ID NO: 29782 - protein, 7 aa, Artificial Sequence
  Description of Artificial Sequence: Synthetic peptide
  XENP020994 vlCDR2
AASNLES

SEQ ID NO: 29783 - protein, 9 aa, Artificial Sequence
  Description of Artificial Sequence: Synthetic peptide
  XENP020994 vlCDR3
QQSNEDPFT

SEQ ID NO: 29784 - protein, 226 aa, Artificial Sequence
  Description of Artificial Sequence: Synthetic polypeptide
  XENP020995 7G8_H0.64_L0_Fab Heavy Chain
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29785 - protein, 121 aa, Artificial Sequence; identical to SEQ ID NO: 18846
  Description of Artificial Sequence: Synthetic polypeptide
  VH of XENP020995

SEQ ID NO: 29786 - protein, 5 aa, Artificial Sequence
  Description of Artificial Sequence: Synthetic peptide
  XENP020995 vhCDR1
DAWMD

SEQ ID NO: 29787 - protein, 19 aa, Artificial Sequence
  Description of Artificial Sequence: Synthetic peptide
  XENP020995 vhCDR2
EIRTKAHNHATYYAESVKG

SEQ ID NO: 29788 - protein, 10 aa, Artificial Sequence
  Description of Artificial Sequence: Synthetic peptide
  XENP020995 vhCDR3
LANWDWYFDV

SEQ ID NO: 29789 - protein, 218 aa, Artificial Sequence; identical to SEQ ID NO: 17590
  Description of Artificial Sequence: Synthetic polypeptide
  XENP020995 7G8_H0.64_L0_Fab Light Chain

SEQ ID NO: 29790 - protein, 111 aa, Artificial Sequence; identical to SEQ ID NO: 17591
  Description of Artificial Sequence: Synthetic polypeptide
  VL of XENP020995

SEQ ID NO: 29791 - protein, 15 aa, Artificial Sequence
  Description of Artificial Sequence: Synthetic peptide
  XENP020995 vlCDR1
KASQSVDYDGDSYMN

SEQ ID NO: 29792 - protein, 7 aa, Artificial Sequence
  Description of Artificial Sequence: Synthetic peptide
  XENP020995 vlCDR2
AASNLES

SEQ ID NO: 29793 - protein, 9 aa, Artificial Sequence
  Description of Artificial Sequence: Synthetic peptide
  XENP020995 vlCDR3
QQSNEDPFT

SEQ ID NO: 29794 - protein, 226 aa, Artificial Sequence
  Description of Artificial Sequence: Synthetic polypeptide
  XENP020996 7G8_H0.65_L0_Fab Heavy Chain
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29795 - protein, 121 aa, Artificial Sequence; identical to SEQ ID NO: 18856
  Description of Artificial Sequence: Synthetic polypeptide
  VH of XENP020996

SEQ ID NO: 29796 - protein, 5 aa, Artificial Sequence
  Description of Artificial Sequence: Synthetic peptide
  XENP020996 vhCDR1
DAWMD

SEQ ID NO: 29797 - protein, 19 aa, Artificial Sequence
  Description of Artificial Sequence: Synthetic peptide
  XENP020996 vhCDR2
EIRTKAENHATYYAESVKG

SEQ ID NO: 29798 - protein, 10 aa, Artificial Sequence
  Description of Artificial Sequence: Synthetic peptide
  XENP020996 vhCDR3
LANWDWYFDV

SEQ ID NO: 29799 - protein, 218 aa, Artificial Sequence; identical to SEQ ID NO: 17590
  Description of Artificial Sequence: Synthetic polypeptide
  XENP020996 7G8_H0.65_L0_Fab Light Chain

SEQ ID NO: 29800 - protein, 111 aa, Artificial Sequence; identical to SEQ ID NO: 17591
  Description of Artificial Sequence: Synthetic polypeptide
  VL of XENP020996

SEQ ID NO: 29801 - protein, 15 aa, Artificial Sequence
  Description of Artificial Sequence: Synthetic peptide
  XENP020996 vlCDR1
KASQSVDYDGDSYMN

SEQ ID NO: 29802 - protein, 7 aa, Artificial Sequence
  Description of Artificial Sequence: Synthetic peptide
  XENP020996 vlCDR2
AASNLES

SEQ ID NO: 29803 - protein, 9 aa, Artificial Sequence
  Description of Artificial Sequence: Synthetic peptide
  XENP020996 vlCDR3
QQSNEDPFT

SEQ ID NO: 29804 - protein, 226 aa, Artificial Sequence
  Description of Artificial Sequence: Synthetic polypeptide
  XENP021001 7G8_H0.66_L0_Fab Heavy Chain
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29805 - protein, 121 aa, Artificial Sequence; identical to SEQ ID NO: 18866
  Description of Artificial Sequence: Synthetic polypeptide
  VH of XENP021001

SEQ ID NO: 29806 - protein, 5 aa, Artificial Sequence
  Description of Artificial Sequence: Synthetic peptide
  XENP021001 vhCDR1
DAWMD

SEQ ID NO: 29807 - protein, 19 aa, Artificial Sequence
  Description of Artificial Sequence: Synthetic peptide
  XENP021001 vhCDR2
EIRTKASNHATYYAESVKG

SEQ ID NO: 29808 - protein, 10 aa, Artificial Sequence
  Description of Artificial Sequence: Synthetic peptide
  XENP021001 vhCDR3
LANWDWYFDV

SEQ ID NO: 29809 - protein, 218 aa, Artificial Sequence; identical to SEQ ID NO: 17590
  Description of Artificial Sequence: Synthetic polypeptide
  XENP021001 7G8_H0.66_L0_Fab Light Chain

SEQ ID NO: 29810 - protein, 111 aa, Artificial Sequence; identical to SEQ ID NO: 17591
  Description of Artificial Sequence: Synthetic polypeptide
  VL of XENP021001

SEQ ID NO: 29811 - protein, 15 aa, Artificial Sequence
  Description of Artificial Sequence: Synthetic peptide
  XENP021001 vlCDR1
KASQSVDYDGDSYMN

SEQ ID NO: 29812 - protein, 7 aa, Artificial Sequence
  Description of Artificial Sequence: Synthetic peptide
  XENP021001 vlCDR2
AASNLES

SEQ ID NO: 29813 - protein, 9 aa, Artificial Sequence
  Description of Artificial Sequence: Synthetic peptide
  XENP021001 vlCDR3
QQSNEDPFT

SEQ ID NO: 29814 - protein, 226 aa, Artificial Sequence
  Description of Artificial Sequence: Synthetic polypeptide
  XENP021002 7G8_H0.67_L0_Fab Heavy Chain
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29815 - protein, 121 aa, Artificial Sequence; identical to SEQ ID NO: 18876
  Description of Artificial Sequence: Synthetic polypeptide
  VH of XENP021002

SEQ ID NO: 29816 - protein, 5 aa, Artificial Sequence
  Description of Artificial Sequence: Synthetic peptide
  XENP021002 vhCDR1
DAWMD

SEQ ID NO: 29817 - protein, 19 aa, Artificial Sequence
  Description of Artificial Sequence: Synthetic peptide
  XENP021002 vhCDR2
EIRTKARNHATYYAESVKG

SEQ ID NO: 29818 - protein, 10 aa, Artificial Sequence
  Description of Artificial Sequence: Synthetic peptide
  XENP021002 vhCDR3
LANWDWYFDV

SEQ ID NO: 29819 - protein, 218 aa, Artificial Sequence; identical to SEQ ID NO: 17590
  Description of Artificial Sequence: Synthetic polypeptide
  XENP021002 7G8_H0.67_L0_Fab Light Chain

SEQ ID NO: 29820 - protein, 111 aa, Artificial Sequence; identical to SEQ ID NO: 17591
  Description of Artificial Sequence: Synthetic polypeptide
  VL of XENP021002

SEQ ID NO: 29821 - protein, 15 aa, Artificial Sequence
  Description of Artificial Sequence: Synthetic peptide
  XENP021002 vlCDR1
KASQSVDYDGDSYMN

SEQ ID NO: 29822 - protein, 7 aa, Artificial Sequence
  Description of Artificial Sequence: Synthetic peptide
  XENP021002 vlCDR2
AASNLES

SEQ ID NO: 29823 - protein, 9 aa, Artificial Sequence
  Description of Artificial Sequence: Synthetic peptide
  XENP021002 vlCDR3
QQSNEDPFT

SEQ ID NO: 29824 - protein, 226 aa, Artificial Sequence
  Description of Artificial Sequence: Synthetic polypeptide
  XENP021003 7G8_H0.68_L0_Fab Heavy Chain
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29825 - protein, 121 aa, Artificial Sequence; identical to SEQ ID NO: 18886
  Description of Artificial Sequence: Synthetic polypeptide
  VH of XENP021003

SEQ ID NO: 29826 - protein, 5 aa, Artificial Sequence
  Description of Artificial Sequence: Synthetic peptide
  XENP021003 vhCDR1
DAWMD

SEQ ID NO: 29827 - protein, 19 aa, Artificial Sequence
  Description of Artificial Sequence: Synthetic peptide
  XENP021003 vhCDR2
EIRTKALNHATYYAESVKG

SEQ ID NO: 29828 - protein, 10 aa, Artificial Sequence
  Description of Artificial Sequence: Synthetic peptide
  XENP021003 vhCDR3
LANWDWYFDV

SEQ ID NO: 29829 - protein, 218 aa, Artificial Sequence; identical to SEQ ID NO: 17590
  Description of Artificial Sequence: Synthetic polypeptide
  XENP021003 7G8_H0.68_L0_Fab Light Chain

SEQ ID NO: 29830 - protein, 111 aa, Artificial Sequence; identical to SEQ ID NO: 17591
  Description of Artificial Sequence: Synthetic polypeptide
  VL of XENP021003

SEQ ID NO: 29831 - protein, 15 aa, Artificial Sequence
  Description of Artificial Sequence: Synthetic peptide
  XENP021003 vlCDR1
KASQSVDYDGDSYMN

SEQ ID NO: 29832 - protein, 7 aa, Artificial Sequence
  Description of Artificial Sequence: Synthetic peptide
  XENP021003 vlCDR2
AASNLES

SEQ ID NO: 29833 - protein, 9 aa, Artificial Sequence
  Description of Artificial Sequence: Synthetic peptide
  XENP021003 vlCDR3
QQSNEDPFT

SEQ ID NO: 29834 - protein, 226 aa, Artificial Sequence
  Description of Artificial Sequence: Synthetic polypeptide
  XENP021004 7G8_H0.69_L0_Fab Heavy Chain
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29835 - protein, 121 aa, Artificial Sequence; identical to SEQ ID NO: 18896
  Description of Artificial Sequence: Synthetic polypeptide
  VH of XENP021004

SEQ ID NO: 29836 - protein, 5 aa, Artificial Sequence
  Description of Artificial Sequence: Synthetic peptide
  XENP021004 vhCDR1
DAWMD

SEQ ID NO: 29837 - protein, 19 aa, Artificial Sequence
  Description of Artificial Sequence: Synthetic peptide
  XENP021004 vhCDR2
EIRTKATNHATYYAESVKG

SEQ ID NO: 29838 - protein, 10 aa, Artificial Sequence
  Description of Artificial Sequence: Synthetic peptide
  XENP021004 vhCDR3
LANWDWYFDV

SEQ ID NO: 29839 - protein, 218 aa, Artificial Sequence; identical to SEQ ID NO: 17590
  Description of Artificial Sequence: Synthetic polypeptide
  XENP021004 7G8_H0.69_L0_Fab Light Chain

SEQ ID NO: 29840 - protein, 111 aa, Artificial Sequence; identical to SEQ ID NO: 17591
  Description of Artificial Sequence: Synthetic polypeptide
  VL of XENP021004

SEQ ID NO: 29841 - protein, 15 aa, Artificial Sequence
  Description of Artificial Sequence: Synthetic peptide
  XENP021004 vlCDR1
KASQSVDYDGDSYMN

SEQ ID NO: 29842 - protein, 7 aa, Artificial Sequence
  Description of Artificial Sequence: Synthetic peptide
  XENP021004 vlCDR2
AASNLES

SEQ ID NO: 29843 - protein, 9 aa, Artificial Sequence
  Description of Artificial Sequence: Synthetic peptide
  XENP021004 vlCDR3
QQSNEDPFT

SEQ ID NO: 29844 - protein, 226 aa, Artificial Sequence
  Description of Artificial Sequence: Synthetic polypeptide
  XENP021005 7G8_H0.70_L0_Fab Heavy Chain
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29845 - protein, 121 aa, Artificial Sequence; identical to SEQ ID NO: 18906
  Description of Artificial Sequence: Synthetic polypeptide
  VH of XENP021005

SEQ ID NO: 29846 - protein, 5 aa, Artificial Sequence
  Description of Artificial Sequence: Synthetic peptide
  XENP021005 vhCDR1
DAWMD

SEQ ID NO: 29847 - protein, 19 aa, Artificial Sequence
  Description of Artificial Sequence: Synthetic peptide
  XENP021005 vhCDR2
EIRTKAGNHATYYAESVKG

SEQ ID NO: 29848 - protein, 10 aa, Artificial Sequence
  Description of Artificial Sequence: Synthetic peptide
  XENP021005 vhCDR3
LANWDWYFDV

SEQ ID NO: 29849 - protein, 218 aa, Artificial Sequence; identical to SEQ ID NO: 17590
  Description of Artificial Sequence: Synthetic polypeptide
  XENP021005 7G8_H0.70_L0_Fab Light Chain

SEQ ID NO: 29850 - protein, 111 aa, Artificial Sequence; identical to SEQ ID NO: 17591
  Description of Artificial Sequence: Synthetic polypeptide
  VL of XENP021005

SEQ ID NO: 29851 - protein, 15 aa, Artificial Sequence
  Description of Artificial Sequence: Synthetic peptide
  XENP021005 vlCDR1
KASQSVDYDGDSYMN

SEQ ID NO: 29852 - protein, 7 aa, Artificial Sequence
  Description of Artificial Sequence: Synthetic peptide
  XENP021005 vlCDR2
AASNLES

SEQ ID NO: 29853 - protein, 9 aa, Artificial Sequence
  Description of Artificial Sequence: Synthetic peptide
  XENP021005 vlCDR3
QQSNEDPFT

SEQ ID NO: 29854 - protein, 226 aa, Artificial Sequence
  Description of Artificial Sequence: Synthetic polypeptide
  XENP021006 7G8_H0.71_L0_Fab Heavy Chain
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29855 - protein, 121 aa, Artificial Sequence; identical to SEQ ID NO: 18916
  Description of Artificial Sequence: Synthetic polypeptide
  VH of XENP021006

SEQ ID NO: 29856 - protein, 5 aa, Artificial Sequence
  Description of Artificial Sequence: Synthetic peptide
  XENP021006 vhCDR1
DAWMD

SEQ ID NO: 29857 - protein, 19 aa, Artificial Sequence
  Description of Artificial Sequence: Synthetic peptide
  XENP021006 vhCDR2
EIRTKAYNHATYYAESVKG

SEQ ID NO: 29858 - protein, 10 aa, Artificial Sequence
  Description of Artificial Sequence: Synthetic peptide
  XENP021006 vhCDR3
LANWDWYFDV

SEQ ID NO: 29859 - protein, 218 aa, Artificial Sequence; identical to SEQ ID NO: 17590
  Description of Artificial Sequence: Synthetic polypeptide
  XENP021006 7G8_H0.71_L0_Fab Light Chain

SEQ ID NO: 29860 - protein, 111 aa, Artificial Sequence; identical to SEQ ID NO: 17591
  Description of Artificial Sequence: Synthetic polypeptide
  VL of XENP021006

SEQ ID NO: 29861 - protein, 15 aa, Artificial Sequence
  Description of Artificial Sequence: Synthetic peptide
  XENP021006 vlCDR1
KASQSVDYDGDSYMN

SEQ ID NO: 29862 - protein, 7 aa, Artificial Sequence
  Description of Artificial Sequence: Synthetic peptide
  XENP021006 vlCDR2
AASNLES

SEQ ID NO: 29863 - protein, 9 aa, Artificial Sequence
  Description of Artificial Sequence: Synthetic peptide
  XENP021006 vlCDR3
QQSNEDPFT

SEQ ID NO: 29864 - protein, 226 aa, Artificial Sequence
  Description of Artificial Sequence: Synthetic polypeptide
  XENP021007 7G8_H0.72_L0_Fab Heavy Chain
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29865 - protein, 121 aa, Artificial Sequence; identical to SEQ ID NO: 18926
  Description of Artificial Sequence: Synthetic polypeptide
  VH of XENP021007

SEQ ID NO: 29866 - protein, 5 aa, Artificial Sequence
  Description of Artificial Sequence: Synthetic peptide
  XENP021007 vhCDR1
DAWMD

SEQ ID NO: 29867 - protein, 19 aa, Artificial Sequence
  Description of Artificial Sequence: Synthetic peptide
  XENP021007 vhCDR2
EIRTKANDHATYYAESVKG

SEQ ID NO: 29868 - protein, 10 aa, Artificial Sequence
  Description of Artificial Sequence: Synthetic peptide
  XENP021007 vhCDR3
LANWDWYFDV

SEQ ID NO: 29869 - protein, 218 aa, Artificial Sequence; identical to SEQ ID NO: 17590
  Description of Artificial Sequence: Synthetic polypeptide
  XENP021007 7G8_H0.72_L0_Fab Light Chain

SEQ ID NO: 29870 - protein, 111 aa, Artificial Sequence; identical to SEQ ID NO: 17591
  Description of Artificial Sequence: Synthetic polypeptide
  VL of XENP021007

SEQ ID NO: 29871 - protein, 15 aa, Artificial Sequence
  Description of Artificial Sequence: Synthetic peptide
  XENP021007 vlCDR1
KASQSVDYDGDSYMN

SEQ ID NO: 29872 - protein, 7 aa, Artificial Sequence
  Description of Artificial Sequence: Synthetic peptide
  XENP021007 vlCDR2
AASNLES

SEQ ID NO: 29873 - protein, 9 aa, Artificial Sequence
  Description of Artificial Sequence: Synthetic peptide
  XENP021007 vlCDR3
QQSNEDPFT

SEQ ID NO: 29874 - protein, 226 aa, Artificial Sequence
  Description of Artificial Sequence: Synthetic polypeptide
  XENP021008 7G8_H0.73_L0_Fab Heavy Chain
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29875 - protein, 121 aa, Artificial Sequence; identical to SEQ ID NO: 18936
  Description of Artificial Sequence: Synthetic polypeptide
  VH of XENP021008

SEQ ID NO: 29876 - protein, 5 aa, Artificial Sequence
  Description of Artificial Sequence: Synthetic peptide
  XENP021008 vhCDR1
DAWMD

SEQ ID NO: 29877 - protein, 19 aa, Artificial Sequence
  Description of Artificial Sequence: Synthetic peptide
  XENP021008 vhCDR2
EIRTKANHHATYYAESVKG

SEQ ID NO: 29878 - protein, 10 aa, Artificial Sequence
  Description of Artificial Sequence: Synthetic peptide
  XENP021008 vhCDR3
LANWDWYFDV

SEQ ID NO: 29879 - protein, 218 aa, Artificial Sequence; identical to SEQ ID NO: 17590
  Description of Artificial Sequence: Synthetic polypeptide
  XENP021008 7G8_H0.73_L0_Fab Light Chain

SEQ ID NO: 29880 - protein, 111 aa, Artificial Sequence; identical to SEQ ID NO: 17591
  Description of Artificial Sequence: Synthetic polypeptide
  VL of XENP021008

SEQ ID NO: 29881 - protein, 15 aa, Artificial Sequence
  Description of Artificial Sequence: Synthetic peptide
  XENP021008 vlCDR1
KASQSVDYDGDSYMN

SEQ ID NO: 29882 - protein, 7 aa, Artificial Sequence
  Description of Artificial Sequence: Synthetic peptide
  XENP021008 vlCDR2
AASNLES

SEQ ID NO: 29883 - protein, 9 aa, Artificial Sequence
  Description of Artificial Sequence: Synthetic peptide
  XENP021008 vlCDR3
QQSNEDPFT

SEQ ID NO: 29884 - protein, 226 aa, Artificial Sequence
  Description of Artificial Sequence: Synthetic polypeptide
  XENP021009 7G8_H0.74_L0_Fab Heavy Chain
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29885 - protein, 121 aa, Artificial Sequence; identical to SEQ ID NO: 18946
  Description of Artificial Sequence: Synthetic polypeptide
  VH of XENP021009

SEQ ID NO: 29886 - protein, 5 aa, Artificial Sequence
  Description of Artificial Sequence: Synthetic peptide
  XENP021009 vhCDR1
DAWMD

SEQ ID NO: 29887 - protein, 19 aa, Artificial Sequence
  Description of Artificial Sequence: Synthetic peptide
  XENP021009 vhCDR2
EIRTKANEHATYYAESVKG

SEQ ID NO: 29888 - protein, 10 aa, Artificial Sequence
  Description of Artificial Sequence: Synthetic peptide
  XENP021009 vhCDR3
LANWDWYFDV

SEQ ID NO: 29889 - protein, 218 aa, Artificial Sequence; identical to SEQ ID NO: 17590
  Description of Artificial Sequence: Synthetic polypeptide
  XENP021009 7G8_H0.74_L0_Fab Light Chain

SEQ ID NO: 29890 - protein, 111 aa, Artificial Sequence; identical to SEQ ID NO: 17591
  Description of Artificial Sequence: Synthetic polypeptide
  VL of XENP021009

SEQ ID NO: 29891 - protein, 15 aa, Artificial Sequence
  Description of Artificial Sequence: Synthetic peptide
  XENP021009 vlCDR1
KASQSVDYDGDSYMN

SEQ ID NO: 29892 - protein, 7 aa, Artificial Sequence
  Description of Artificial Sequence: Synthetic peptide
  XENP021009 vlCDR2
AASNLES

SEQ ID NO: 29893 - protein, 9 aa, Artificial Sequence
  Description of Artificial Sequence: Synthetic peptide
  XENP021009 vlCDR3
QQSNEDPFT

SEQ ID NO: 29894 - protein, 226 aa, Artificial Sequence
  Description of Artificial Sequence: Synthetic polypeptide
  XENP021010 7G8_H0.75_L0_Fab Heavy Chain
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29895 - protein, 121 aa, Artificial Sequence; identical to SEQ ID NO: 18956
  Description of Artificial Sequence: Synthetic polypeptide
  VH of XENP021010

SEQ ID NO: 29896 - protein, 5 aa, Artificial Sequence
  Description of Artificial Sequence: Synthetic peptide
  XENP021010 vhCDR1
DAWMD

SEQ ID NO: 29897 - protein, 19 aa, Artificial Sequence
  Description of Artificial Sequence: Synthetic peptide
  XENP021010 vhCDR2
EIRTKANSHATYYAESVKG

SEQ ID NO: 29898 - protein, 10 aa, Artificial Sequence
  Description of Artificial Sequence: Synthetic peptide
  XENP021010 vhCDR3
LANWDWYFDV

SEQ ID NO: 29899 - protein, 218 aa, Artificial Sequence; identical to SEQ ID NO: 17590
  Description of Artificial Sequence: Synthetic polypeptide
  XENP021010 7G8_H0.75_L0_Fab Light Chain

SEQ ID NO: 29900 - protein, 111 aa, Artificial Sequence; identical to SEQ ID NO: 17591
  Description of Artificial Sequence: Synthetic polypeptide
  VL of XENP021010

SEQ ID NO: 29901 - protein, 15 aa, Artificial Sequence
  Description of Artificial Sequence: Synthetic peptide
  XENP021010 vlCDR1
KASQSVDYDGDSYMN

SEQ ID NO: 29902 - protein, 7 aa, Artificial Sequence
  Description of Artificial Sequence: Synthetic peptide
  XENP021010 vlCDR2
AASNLES

SEQ ID NO: 29903 - protein, 9 aa, Artificial Sequence
  Description of Artificial Sequence: Synthetic peptide
  XENP021010 vlCDR3
QQSNEDPFT

SEQ ID NO: 29904 - protein, 226 aa, Artificial Sequence
  Description of Artificial Sequence: Synthetic polypeptide
  XENP021011 7G8_H0.76_L0_Fab Heavy Chain
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29905 - protein, 121 aa, Artificial Sequence; identical to SEQ ID NO: 18966
  Description of Artificial Sequence: Synthetic polypeptide
  VH of XENP021011

SEQ ID NO: 29906 - protein, 5 aa, Artificial Sequence
  Description of Artificial Sequence: Synthetic peptide
  XENP021011 vhCDR1
DAWMD

SEQ ID NO: 29907 - protein, 19 aa, Artificial Sequence
  Description of Artificial Sequence: Synthetic peptide
  XENP021011 vhCDR2
EIRTKANRHATYYAESVKG

SEQ ID NO: 29908 - protein, 10 aa, Artificial Sequence
  Description of Artificial Sequence: Synthetic peptide
  XENP021011 vhCDR3
LANWDWYFDV

SEQ ID NO: 29909 - protein, 218 aa, Artificial Sequence; identical to SEQ ID NO: 17590
  Description of Artificial Sequence: Synthetic polypeptide
  XENP021011 7G8_H0.76_L0_Fab Light Chain

SEQ ID NO: 29910 - protein, 111 aa, Artificial Sequence; identical to SEQ ID NO: 17591
  Description of Artificial Sequence: Synthetic polypeptide
  VL of XENP021011

SEQ ID NO: 29911 - protein, 15 aa, Artificial Sequence
  Description of Artificial Sequence: Synthetic peptide
  XENP021011 vlCDR1
KASQSVDYDGDSYMN

SEQ ID NO: 29912 - protein, 7 aa, Artificial Sequence
  Description of Artificial Sequence: Synthetic peptide
  XENP021011 vlCDR2
AASNLES

SEQ ID NO: 29913 - protein, 9 aa, Artificial Sequence
  Description of Artificial Sequence: Synthetic peptide
  XENP021011 vlCDR3
QQSNEDPFT

SEQ ID NO: 29914 - protein, 226 aa, Artificial Sequence
  Description of Artificial Sequence: Synthetic polypeptide
  XENP021012 7G8_H0.77_L0_Fab Heavy Chain
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29915 - protein, 121 aa, Artificial Sequence; identical to SEQ ID NO: 18976
  Description of Artificial Sequence: Synthetic polypeptide
  VH of XENP021012

SEQ ID NO: 29916 - protein, 5 aa, Artificial Sequence
  Description of Artificial Sequence: Synthetic peptide
  XENP021012 vhCDR1
DAWMD

SEQ ID NO: 29917 - protein, 19 aa, Artificial Sequence
  Description of Artificial Sequence: Synthetic peptide
  XENP021012 vhCDR2
EIRTKANLHATYYAESVKG

SEQ ID NO: 29918 - protein, 10 aa, Artificial Sequence
  Description of Artificial Sequence: Synthetic peptide
  XENP021012 vhCDR3
LANWDWYFDV

SEQ ID NO: 29919 - protein, 218 aa, Artificial Sequence; identical to SEQ ID NO: 17590
  Description of Artificial Sequence: Synthetic polypeptide
  XENP021012 7G8_H0.77_L0_Fab Light Chain

SEQ ID NO: 29920 - protein, 111 aa, Artificial Sequence; identical to SEQ ID NO: 17591
  Description of Artificial Sequence: Synthetic polypeptide
  VL of XENP021012

SEQ ID NO: 29921 - protein, 15 aa, Artificial Sequence
  Description of Artificial Sequence: Synthetic peptide
  XENP021012 vlCDR1
KASQSVDYDGDSYMN

SEQ ID NO: 29922 - protein, 7 aa, Artificial Sequence
  Description of Artificial Sequence: Synthetic peptide
  XENP021012 vlCDR2
AASNLES

SEQ ID NO: 29923 - protein, 9 aa, Artificial Sequence
  Description of Artificial Sequence: Synthetic peptide
  XENP021012 vlCDR3
QQSNEDPFT

SEQ ID NO: 29924 - protein, 226 aa, Artificial Sequence
  Description of Artificial Sequence: Synthetic polypeptide
  XENP021013 7G8_H0.78_L0_Fab Heavy Chain
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29925 - protein, 121 aa, Artificial Sequence; identical to SEQ ID NO: 18986
  Description of Artificial Sequence: Synthetic polypeptide
  VH of XENP021013

SEQ ID NO: 29926 - protein, 5 aa, Artificial Sequence
  Description of Artificial Sequence: Synthetic peptide
  XENP021013 vhCDR1
DAWMD

SEQ ID NO: 29927 - protein, 19 aa, Artificial Sequence
  Description of Artificial Sequence: Synthetic peptide
  XENP021013 vhCDR2
EIRTKANTHATYYAESVKG

SEQ ID NO: 29928 - protein, 10 aa, Artificial Sequence
  Description of Artificial Sequence: Synthetic peptide
  XENP021013 vhCDR3
LANWDWYFDV

SEQ ID NO: 29929 - protein, 218 aa, Artificial Sequence; identical to SEQ ID NO: 17590
  Description of Artificial Sequence: Synthetic polypeptide
  XENP021013 7G8_H0.78_L0_Fab Light Chain

SEQ ID NO: 29930 - protein, 111 aa, Artificial Sequence; identical to SEQ ID NO: 17591
  Description of Artificial Sequence: Synthetic polypeptide
  VL of XENP021013

SEQ ID NO: 29931 - protein, 15 aa, Artificial Sequence
  Description of Artificial Sequence: Synthetic peptide
  XENP021013 vlCDR1
KASQSVDYDGDSYMN

SEQ ID NO: 29932 - protein, 7 aa, Artificial Sequence
  Description of Artificial Sequence: Synthetic peptide
  XENP021013 vlCDR2
AASNLES

SEQ ID NO: 29933 - protein, 9 aa, Artificial Sequence
  Description of Artificial Sequence: Synthetic peptide
  XENP021013 vlCDR3
QQSNEDPFT

SEQ ID NO: 29934 - protein, 226 aa, Artificial Sequence
  Description of Artificial Sequence: Synthetic polypeptide
  XENP021014 7G8_H0.79_L0_Fab Heavy Chain
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29935 - protein, 121 aa, Artificial Sequence; identical to SEQ ID NO: 18996
  Description of Artificial Sequence: Synthetic polypeptide
  VH of XENP021014

SEQ ID NO: 29936 - protein, 5 aa, Artificial Sequence
  Description of Artificial Sequence: Synthetic peptide
  XENP021014 vhCDR1
DAWMD

SEQ ID NO: 29937 - protein, 19 aa, Artificial Sequence
  Description of Artificial Sequence: Synthetic peptide
  XENP021014 vhCDR2
EIRTKANGHATYYAESVKG

SEQ ID NO: 29938 - protein, 10 aa, Artificial Sequence
  Description of Artificial Sequence: Synthetic peptide
  XENP021014 vhCDR3
LANWDWYFDV

SEQ ID NO: 29939 - protein, 218 aa, Artificial Sequence; identical to SEQ ID NO: 17590
  Description of Artificial Sequence: Synthetic polypeptide
  XENP021014 7G8_H0.79_L0_Fab Light Chain

SEQ ID NO: 29940 - protein, 111 aa, Artificial Sequence; identical to SEQ ID NO: 17591
  Description of Artificial Sequence: Synthetic polypeptide
  VL of XENP021014

SEQ ID NO: 29941 - protein, 15 aa, Artificial Sequence
  Description of Artificial Sequence: Synthetic peptide
  XENP021014 vlCDR1
KASQSVDYDGDSYMN

SEQ ID NO: 29942 - protein, 7 aa, Artificial Sequence
  Description of Artificial Sequence: Synthetic peptide
  XENP021014 vlCDR2
AASNLES

SEQ ID NO: 29943 - protein, 9 aa, Artificial Sequence
  Description of Artificial Sequence: Synthetic peptide
  XENP021014 vlCDR3
QQSNEDPFT

SEQ ID NO: 29944 - protein, 226 aa, Artificial Sequence
  Description of Artificial Sequence: Synthetic polypeptide
  XENP021015 7G8_H0.80_L0_Fab Heavy Chain
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29945 - protein, 121 aa, Artificial Sequence; identical to SEQ ID NO: 19006
  Description of Artificial Sequence: Synthetic polypeptide
  VH of XENP021015

SEQ ID NO: 29946 - protein, 5 aa, Artificial Sequence
  Description of Artificial Sequence: Synthetic peptide
  XENP021015 vhCDR1
DAWMD

SEQ ID NO: 29947 - protein, 19 aa, Artificial Sequence
  Description of Artificial Sequence: Synthetic peptide
  XENP021015 vhCDR2
EIRTKANYHATYYAESVKG

SEQ ID NO: 29948 - protein, 10 aa, Artificial Sequence
  Description of Artificial Sequence: Synthetic peptide
  XENP021015 vhCDR3
LANWDWYFDV

SEQ ID NO: 29949 - protein, 218 aa, Artificial Sequence; identical to SEQ ID NO: 17590
  Description of Artificial Sequence: Synthetic polypeptide
  XENP021015 7G8_H0.80_L0_Fab Light Chain

SEQ ID NO: 29950 - protein, 111 aa, Artificial Sequence; identical to SEQ ID NO: 17591
  Description of Artificial Sequence: Synthetic polypeptide
  VL of XENP021015

SEQ ID NO: 29951 - protein, 15 aa, Artificial Sequence
  Description of Artificial Sequence: Synthetic peptide
  XENP021015 vlCDR1
KASQSVDYDGDSYMN

SEQ ID NO: 29952 - protein, 7 aa, Artificial Sequence
  Description of Artificial Sequence: Synthetic peptide
  XENP021015 vlCDR2
AASNLES

SEQ ID NO: 29953 - protein, 9 aa, Artificial Sequence
  Description of Artificial Sequence: Synthetic peptide
  XENP021015 vlCDR3
QQSNEDPFT

SEQ ID NO: 29954 - protein, 226 aa, Artificial Sequence
  Description of Artificial Sequence: Synthetic polypeptide
  XENP021016 7G8_H0.81_L0_Fab Heavy Chain
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29955 - protein, 121 aa, Artificial Sequence; identical to SEQ ID NO: 19016
  Description of Artificial Sequence: Synthetic polypeptide
  VH of XENP021016

SEQ ID NO: 29956 - protein, 5 aa, Artificial Sequence
  Description of Artificial Sequence: Synthetic peptide
  XENP021016 vhCDR1
DAWMD

SEQ ID NO: 29957 - protein, 19 aa, Artificial Sequence
  Description of Artificial Sequence: Synthetic peptide
  XENP021016 vhCDR2
EIRTKANNYATYYAESVKG

SEQ ID NO: 29958 - protein, 10 aa, Artificial Sequence
  Description of Artificial Sequence: Synthetic peptide
  XENP021016 vhCDR3
LANWDWYFDV

SEQ ID NO: 29959 - protein, 218 aa, Artificial Sequence; identical to SEQ ID NO: 17590
  Description of Artificial Sequence: Synthetic polypeptide
  XENP021016 7G8_H0.81_L0_Fab Light Chain

SEQ ID NO: 29960 - protein, 111 aa, Artificial Sequence; identical to SEQ ID NO: 17591
  Description of Artificial Sequence: Synthetic polypeptide
  VL of XENP021016

SEQ ID NO: 29961 - protein, 15 aa, Artificial Sequence
  Description of Artificial Sequence: Synthetic peptide
  XENP021016 vlCDR1
KASQSVDYDGDSYMN

SEQ ID NO: 29962 - protein, 7 aa, Artificial Sequence
  Description of Artificial Sequence: Synthetic peptide
  XENP021016 vlCDR2
AASNLES

SEQ ID NO: 29963 - protein, 9 aa, Artificial Sequence
  Description of Artificial Sequence: Synthetic peptide
  XENP021016 vlCDR3
QQSNEDPFT

SEQ ID NO: 29964 - protein, 226 aa, Artificial Sequence
  Description of Artificial Sequence: Synthetic polypeptide
  XENP021017 7G8_H0.82_L0_Fab Heavy Chain
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29965 - protein, 121 aa, Artificial Sequence; identical to SEQ ID NO: 19026
  Description of Artificial Sequence: Synthetic polypeptide
  VH of XENP021017

SEQ ID NO: 29966 - protein, 5 aa, Artificial Sequence
  Description of Artificial Sequence: Synthetic peptide
  XENP021017 vhCDR1
DAWMD

SEQ ID NO: 29967 - protein, 19 aa, Artificial Sequence
  Description of Artificial Sequence: Synthetic peptide
  XENP021017 vhCDR2
EIRTKANNQATYYAESVKG

SEQ ID NO: 29968 - protein, 10 aa, Artificial Sequence
  Description of Artificial Sequence: Synthetic peptide
  XENP021017 vhCDR3
LANWDWYFDV

SEQ ID NO: 29969 - protein, 218 aa, Artificial Sequence; identical to SEQ ID NO: 17590
  Description of Artificial Sequence: Synthetic polypeptide
  XENP021017 7G8_H0.82_L0_Fab Light Chain

SEQ ID NO: 29970 - protein, 111 aa, Artificial Sequence; identical to SEQ ID NO: 17591
  Description of Artificial Sequence: Synthetic polypeptide
  VL of XENP021017

SEQ ID NO: 29971 - protein, 15 aa, Artificial Sequence
  Description of Artificial Sequence: Synthetic peptide
  XENP021017 vlCDR1
KASQSVDYDGDSYMN

SEQ ID NO: 29972 - protein, 7 aa, Artificial Sequence
  Description of Artificial Sequence: Synthetic peptide
  XENP021017 vlCDR2
AASNLES

SEQ ID NO: 29973 - protein, 9 aa, Artificial Sequence
  Description of Artificial Sequence: Synthetic peptide
  XENP021017 vlCDR3
QQSNEDPFT

SEQ ID NO: 29974 - protein, 226 aa, Artificial Sequence
  Description of Artificial Sequence: Synthetic polypeptide
  XENP021018 7G8_H0.83_L0_Fab Heavy Chain
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29975 - protein, 121 aa, Artificial Sequence; identical to SEQ ID NO: 19036
  Description of Artificial Sequence: Synthetic polypeptide
  VH of XENP021018

SEQ ID NO: 29976 - protein, 5 aa, Artificial Sequence
  Description of Artificial Sequence: Synthetic peptide
  XENP021018 vhCDR1
DAWMD

SEQ ID NO: 29977 - protein, 19 aa, Artificial Sequence
  Description of Artificial Sequence: Synthetic peptide
  XENP021018 vhCDR2
EIRTKANNDATYYAESVKG

SEQ ID NO: 29978 - protein, 10 aa, Artificial Sequence
  Description of Artificial Sequence: Synthetic peptide
  XENP021018 vhCDR3
LANWDWYFDV

SEQ ID NO: 29979 - protein, 218 aa, Artificial Sequence; identical to SEQ ID NO: 17590
  Description of Artificial Sequence: Synthetic polypeptide
  XENP021018 7G8_H0.83_L0_Fab Light Chain

SEQ ID NO: 29980 - protein, 111 aa, Artificial Sequence; identical to SEQ ID NO: 17591
  Description of Artificial Sequence: Synthetic polypeptide
  VL of XENP021018

SEQ ID NO: 29981 - protein, 15 aa, Artificial Sequence
  Description of Artificial Sequence: Synthetic peptide
  XENP021018 vlCDR1
KASQSVDYDGDSYMN

SEQ ID NO: 29982 - protein, 7 aa, Artificial Sequence
  Description of Artificial Sequence: Synthetic peptide
  XENP021018 vlCDR2
AASNLES

SEQ ID NO: 29983 - protein, 9 aa, Artificial Sequence
  Description of Artificial Sequence: Synthetic peptide
  XENP021018 vlCDR3
QQSNEDPFT

SEQ ID NO: 29984 - protein, 226 aa, Artificial Sequence
  Description of Artificial Sequence: Synthetic polypeptide
  XENP021019 7G8_H0.84_L0_Fab Heavy Chain
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29985 - protein, 121 aa, Artificial Sequence; identical to SEQ ID NO: 19046
  Description of Artificial Sequence: Synthetic polypeptide
  VH of XENP021019

SEQ ID NO: 29986 - protein, 5 aa, Artificial Sequence
  Description of Artificial Sequence: Synthetic peptide
  XENP021019 vhCDR1
DAWMD

SEQ ID NO: 29987 - protein, 19 aa, Artificial Sequence
  Description of Artificial Sequence: Synthetic peptide
  XENP021019 vhCDR2
EIRTKANNFATYYAESVKG

SEQ ID NO: 29988 - protein, 10 aa, Artificial Sequence
  Description of Artificial Sequence: Synthetic peptide
  XENP021019 vhCDR3
LANWDWYFDV

SEQ ID NO: 29989 - protein, 218 aa, Artificial Sequence; identical to SEQ ID NO: 17590
  Description of Artificial Sequence: Synthetic polypeptide
  XENP021019 7G8_H0.84_L0_Fab Light Chain

SEQ ID NO: 29990 - protein, 111 aa, Artificial Sequence; identical to SEQ ID NO: 17591
  Description of Artificial Sequence: Synthetic polypeptide
  VL of XENP021019

SEQ ID NO: 29991 - protein, 15 aa, Artificial Sequence
  Description of Artificial Sequence: Synthetic peptide
  XENP021019 vlCDR1
KASQSVDYDGDSYMN

SEQ ID NO: 29992 - protein, 7 aa, Artificial Sequence
  Description of Artificial Sequence: Synthetic peptide
  XENP021019 vlCDR2
AASNLES

SEQ ID NO: 29993 - protein, 9 aa, Artificial Sequence
  Description of Artificial Sequence: Synthetic peptide
  XENP021019 vlCDR3
QQSNEDPFT

SEQ ID NO: 29994 - protein, 226 aa, Artificial Sequence
  Description of Artificial Sequence: Synthetic polypeptide
  XENP021020 7G8_H0.85_L0_Fab Heavy Chain
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 29995 - protein, 121 aa, Artificial Sequence; identical to SEQ ID NO: 19056
  Description of Artificial Sequence: Synthetic polypeptide
  VH of XENP021020

SEQ ID NO: 29996 - protein, 5 aa, Artificial Sequence
  Description of Artificial Sequence: Synthetic peptide
  XENP021020 vhCDR1
DAWMD

SEQ ID NO: 29997 - protein, 19 aa, Artificial Sequence
  Description of Artificial Sequence: Synthetic peptide
  XENP021020 vhCDR2
EIRTKANNAATYYAESVKG

SEQ ID NO: 29998 - protein, 10 aa, Artificial Sequence
  Description of Artificial Sequence: Synthetic peptide
  XENP021020 vhCDR3
LANWDWYFDV

SEQ ID NO: 29999 - protein, 218 aa, Artificial Sequence; identical to SEQ ID NO: 17590
  Description of Artificial Sequence: Synthetic polypeptide
  XENP021020 7G8_H0.85_L0_Fab Light Chain

SEQ ID NO: 30000 - protein, 111 aa, Artificial Sequence; identical to SEQ ID NO: 17591
  Description of Artificial Sequence: Synthetic polypeptide
  VL of XENP021020

SEQ ID NO: 30001 - protein, 15 aa, Artificial Sequence
  Description of Artificial Sequence: Synthetic peptide
  XENP021020 vlCDR1
KASQSVDYDGDSYMN

SEQ ID NO: 30002 - protein, 7 aa, Artificial Sequence
  Description of Artificial Sequence: Synthetic peptide
  XENP021020 vlCDR2
AASNLES

SEQ ID NO: 30003 - protein, 9 aa, Artificial Sequence
  Description of Artificial Sequence: Synthetic peptide
  XENP021020 vlCDR3
QQSNEDPFT

SEQ ID NO: 30004 - protein, 226 aa, Artificial Sequence
  Description of Artificial Sequence: Synthetic polypeptide
  XENP021021 7G8_H0.86_L0_Fab Heavy Chain
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30005 - protein, 121 aa, Artificial Sequence; identical to SEQ ID NO: 19066
  Description of Artificial Sequence: Synthetic polypeptide
  VH of XENP021021

SEQ ID NO: 30006 - protein, 5 aa, Artificial Sequence
  Description of Artificial Sequence: Synthetic peptide
  XENP021021 vhCDR1
DAWMD

SEQ ID NO: 30007 - protein, 19 aa, Artificial Sequence
  Description of Artificial Sequence: Synthetic peptide
  XENP021021 vhCDR2
EIRTKANNKATYYAESVKG

SEQ ID NO: 30008 - protein, 10 aa, Artificial Sequence
  Description of Artificial Sequence: Synthetic peptide
  XENP021021 vhCDR3
LANWDWYFDV

SEQ ID NO: 30009 - protein, 218 aa, Artificial Sequence; identical to SEQ ID NO: 17590
  Description of Artificial Sequence: Synthetic polypeptide
  XENP021021 7G8_H0.86_L0_Fab Light Chain

SEQ ID NO: 30010 - protein, 111 aa, Artificial Sequence; identical to SEQ ID NO: 17591
  Description of Artificial Sequence: Synthetic polypeptide
  VL of XENP021021

SEQ ID NO: 30011 - protein, 15 aa, Artificial Sequence
  Description of Artificial Sequence: Synthetic peptide
  XENP021021 vlCDR1
KASQSVDYDGDSYMN

SEQ ID NO: 30012 - protein, 7 aa, Artificial Sequence
  Description of Artificial Sequence: Synthetic peptide
  XENP021021 vlCDR2
AASNLES

SEQ ID NO: 30013 - protein, 9 aa, Artificial Sequence
  Description of Artificial Sequence: Synthetic peptide
  XENP021021 vlCDR3
QQSNEDPFT

SEQ ID NO: 30014 - protein, 226 aa, Artificial Sequence
  Description of Artificial Sequence: Synthetic polypeptide
  XENP021022 7G8_H0.87_L0_Fab Heavy Chain
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30015 - protein, 121 aa, Artificial Sequence; identical to SEQ ID NO: 19076
  Description of Artificial Sequence: Synthetic polypeptide
  VH of XENP021022

SEQ ID NO: 30016 - protein, 5 aa, Artificial Sequence
  Description of Artificial Sequence: Synthetic peptide
  XENP021022 vhCDR1
DAWMD

SEQ ID NO: 30017 - protein, 19 aa, Artificial Sequence
  Description of Artificial Sequence: Synthetic peptide
  XENP021022 vhCDR2
EIRTKANNGATYYAESVKG

SEQ ID NO: 30018 - protein, 10 aa, Artificial Sequence
  Description of Artificial Sequence: Synthetic peptide
  XENP021022 vhCDR3
LANWDWYFDV

SEQ ID NO: 30019 - protein, 218 aa, Artificial Sequence; identical to SEQ ID NO: 17590
  Description of Artificial Sequence: Synthetic polypeptide
  XENP021022 7G8_H0.87_L0_Fab Light Chain

SEQ ID NO: 30020 - protein, 111 aa, Artificial Sequence; identical to SEQ ID NO: 17591
  Description of Artificial Sequence: Synthetic polypeptide
  VL of XENP021022

SEQ ID NO: 30021 - protein, 15 aa, Artificial Sequence
  Description of Artificial Sequence: Synthetic peptide
  XENP021022 vlCDR1
KASQSVDYDGDSYMN

SEQ ID NO: 30022 - protein, 7 aa, Artificial Sequence
  Description of Artificial Sequence: Synthetic peptide
  XENP021022 vlCDR2
AASNLES

SEQ ID NO: 30023 - protein, 9 aa, Artificial Sequence
  Description of Artificial Sequence: Synthetic peptide
  XENP021022 vlCDR3
QQSNEDPFT

SEQ ID NO: 30024 - protein, 226 aa, Artificial Sequence
  Description of Artificial Sequence: Synthetic polypeptide
  XENP021023 7G8_H0.88_L0_Fab Heavy Chain
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30025 - protein, 121 aa, Artificial Sequence; identical to SEQ ID NO: 19086
  Description of Artificial Sequence: Synthetic polypeptide
  VH of XENP021023

SEQ ID NO: 30026 - protein, 5 aa, Artificial Sequence
  Description of Artificial Sequence: Synthetic peptide
  XENP021023 vhCDR1
DAWMD

SEQ ID NO: 30027 - protein, 19 aa, Artificial Sequence
  Description of Artificial Sequence: Synthetic peptide
  XENP021023 vhCDR2
EIRTKANNLATYYAESVKG

SEQ ID NO: 30028 - protein, 10 aa, Artificial Sequence
  Description of Artificial Sequence: Synthetic peptide
  XENP021023 vhCDR3
LANWDWYFDV

SEQ ID NO: 30029 - protein, 218 aa, Artificial Sequence; identical to SEQ ID NO: 17590
  Description of Artificial Sequence: Synthetic polypeptide
  XENP021023 7G8_H0.88_L0_Fab Light Chain

SEQ ID NO: 30030 - protein, 111 aa, Artificial Sequence; identical to SEQ ID NO: 17591
  Description of Artificial Sequence: Synthetic polypeptide
  VL of XENP021023

SEQ ID NO: 30031 - protein, 15 aa, Artificial Sequence
  Description of Artificial Sequence: Synthetic peptide
  XENP021023 vlCDR1
KASQSVDYDGDSYMN

SEQ ID NO: 30032 - protein, 7 aa, Artificial Sequence
  Description of Artificial Sequence: Synthetic peptide
  XENP021023 vlCDR2
AASNLES

SEQ ID NO: 30033 - protein, 9 aa, Artificial Sequence
  Description of Artificial Sequence: Synthetic peptide
  XENP021023 vlCDR3
QQSNEDPFT

SEQ ID NO: 30034 - protein, 226 aa, Artificial Sequence
  Description of Artificial Sequence: Synthetic polypeptide
  XENP021024 7G8_H0.89_L0_Fab Heavy Chain
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30035 - protein, 121 aa, Artificial Sequence; identical to SEQ ID NO: 19096
  Description of Artificial Sequence: Synthetic polypeptide
  VH of XENP021024

SEQ ID NO: 30036 - protein, 5 aa, Artificial Sequence
  Description of Artificial Sequence: Synthetic peptide
  XENP021024 vhCDR1
DAWMD

SEQ ID NO: 30037 - protein, 19 aa, Artificial Sequence
  Description of Artificial Sequence: Synthetic peptide
  XENP021024 vhCDR2
EIRTKANNHGTYYAESVKG

SEQ ID NO: 30038 - protein, 10 aa, Artificial Sequence
  Description of Artificial Sequence: Synthetic peptide
  XENP021024 vhCDR3
LANWDWYFDV

SEQ ID NO: 30039 - protein, 218 aa, Artificial Sequence; identical to SEQ ID NO: 17590
  Description of Artificial Sequence: Synthetic polypeptide
  XENP021024 7G8_H0.89_L0_Fab Light Chain

SEQ ID NO: 30040 - protein, 111 aa, Artificial Sequence; identical to SEQ ID NO: 17591
  Description of Artificial Sequence: Synthetic polypeptide
  VL of XENP021024

SEQ ID NO: 30041 - protein, 15 aa, Artificial Sequence
  Description of Artificial Sequence: Synthetic peptide
  XENP021024 vlCDR1
KASQSVDYDGDSYMN

SEQ ID NO: 30042 - protein, 7 aa, Artificial Sequence
  Description of Artificial Sequence: Synthetic peptide
  XENP021024 vlCDR2
AASNLES

SEQ ID NO: 30043 - protein, 9 aa, Artificial Sequence
  Description of Artificial Sequence: Synthetic peptide
  XENP021024 vlCDR3
QQSNEDPFT

SEQ ID NO: 30044 - protein, 226 aa, Artificial Sequence
  Description of Artificial Sequence: Synthetic polypeptide
  XENP021025 7G8_H0.90_L0_Fab Heavy Chain
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30045 - protein, 121 aa, Artificial Sequence; identical to SEQ ID NO: 19106
  Description of Artificial Sequence: Synthetic polypeptide
  VH of XENP021025

SEQ ID NO: 30046 - protein, 5 aa, Artificial Sequence
  Description of Artificial Sequence: Synthetic peptide
  XENP021025 vhCDR1
DAWMD

SEQ ID NO: 30047 - protein, 19 aa, Artificial Sequence
  Description of Artificial Sequence: Synthetic peptide
  XENP021025 vhCDR2
EIRTKANNHHTYYAESVKG

SEQ ID NO: 30048 - protein, 10 aa, Artificial Sequence
  Description of Artificial Sequence: Synthetic peptide
  XENP021025 vhCDR3
LANWDWYFDV

SEQ ID NO: 30049 - protein, 218 aa, Artificial Sequence; identical to SEQ ID NO: 17590
  Description of Artificial Sequence: Synthetic polypeptide
  XENP021025 7G8_H0.90_L0_Fab Light Chain

SEQ ID NO: 30050 - protein, 111 aa, Artificial Sequence; identical to SEQ ID NO: 17591
  Description of Artificial Sequence: Synthetic polypeptide
  VL of XENP021025

SEQ ID NO: 30051 - protein, 15 aa, Artificial Sequence
  Description of Artificial Sequence: Synthetic peptide
  XENP021025 vlCDR1
KASQSVDYDGDSYMN

SEQ ID NO: 30052 - protein, 7 aa, Artificial Sequence
  Description of Artificial Sequence: Synthetic peptide
  XENP021025 vlCDR2
AASNLES

SEQ ID NO: 30053 - protein, 9 aa, Artificial Sequence
  Description of Artificial Sequence: Synthetic peptide
  XENP021025 vlCDR3
QQSNEDPFT

SEQ ID NO: 30054 - protein, 226 aa, Artificial Sequence
  Description of Artificial Sequence: Synthetic polypeptide
  XENP021026 7G8_H0.91_L0_Fab Heavy Chain
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30055 - protein, 121 aa, Artificial Sequence; identical to SEQ ID NO: 19116
  Description of Artificial Sequence: Synthetic polypeptide
  VH of XENP021026

SEQ ID NO: 30056 - protein, 5 aa, Artificial Sequence
  Description of Artificial Sequence: Synthetic peptide
  XENP021026 vhCDR1
DAWMD

SEQ ID NO: 30057 - protein, 19 aa, Artificial Sequence
  Description of Artificial Sequence: Synthetic peptide
  XENP021026 vhCDR2
EIRTKANNHQTYYAESVKG

SEQ ID NO: 30058 - protein, 10 aa, Artificial Sequence
  Description of Artificial Sequence: Synthetic peptide
  XENP021026 vhCDR3
LANWDWYFDV

SEQ ID NO: 30059 - protein, 218 aa, Artificial Sequence; identical to SEQ ID NO: 17590
  Description of Artificial Sequence: Synthetic polypeptide
  XENP021026 7G8_H0.91_L0_Fab Light Chain

SEQ ID NO: 30060 - protein, 111 aa, Artificial Sequence; identical to SEQ ID NO: 17591
  Description of Artificial Sequence: Synthetic polypeptide
  VL of XENP021026

SEQ ID NO: 30061 - protein, 15 aa, Artificial Sequence
  Description of Artificial Sequence: Synthetic peptide
  XENP021026 vlCDR1
KASQSVDYDGDSYMN

SEQ ID NO: 30062 - protein, 7 aa, Artificial Sequence
  Description of Artificial Sequence: Synthetic peptide
  XENP021026 vlCDR2
AASNLES

SEQ ID NO: 30063 - protein, 9 aa, Artificial Sequence
  Description of Artificial Sequence: Synthetic peptide
  XENP021026 vlCDR3
QQSNEDPFT

SEQ ID NO: 30064 - protein, 226 aa, Artificial Sequence
  Description of Artificial Sequence: Synthetic polypeptide
  XENP021027 7G8_H0.92_L0_Fab Heavy Chain
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30065 - protein, 121 aa, Artificial Sequence; identical to SEQ ID NO: 19126
  Description of Artificial Sequence: Synthetic polypeptide
  VH of XENP021027

SEQ ID NO: 30066 - protein, 5 aa, Artificial Sequence
  Description of Artificial Sequence: Synthetic peptide
  XENP021027 vhCDR1
DAWMD

SEQ ID NO: 30067 - protein, 19 aa, Artificial Sequence
  Description of Artificial Sequence: Synthetic peptide
  XENP021027 vhCDR2
EIRTKANNHDTYYAESVKG

SEQ ID NO: 30068 - protein, 10 aa, Artificial Sequence
  Description of Artificial Sequence: Synthetic peptide
  XENP021027 vhCDR3
LANWDWYFDV

SEQ ID NO: 30069 - protein, 218 aa, Artificial Sequence; identical to SEQ ID NO: 17590
  Description of Artificial Sequence: Synthetic polypeptide
  XENP021027 7G8_H0.92_L0_Fab Light Chain

SEQ ID NO: 30070 - protein, 111 aa, Artificial Sequence; identical to SEQ ID NO: 17591
  Description of Artificial Sequence: Synthetic polypeptide
  VL of XENP021027

SEQ ID NO: 30071 - protein, 15 aa, Artificial Sequence
  Description of Artificial Sequence: Synthetic peptide
  XENP021027 vlCDR1
KASQSVDYDGDSYMN

SEQ ID NO: 30072 - protein, 7 aa, Artificial Sequence
  Description of Artificial Sequence: Synthetic peptide
  XENP021027 vlCDR2
AASNLES

SEQ ID NO: 30073 - protein, 9 aa, Artificial Sequence
  Description of Artificial Sequence: Synthetic peptide
  XENP021027 vlCDR3
QQSNEDPFT

SEQ ID NO: 30074 - protein, 226 aa, Artificial Sequence
  Description of Artificial Sequence: Synthetic polypeptide
  XENP021028 7G8_H0.93_L0_Fab Heavy Chain
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30075 - protein, 121 aa, Artificial Sequence; identical to SEQ ID NO: 19136
  Description of Artificial Sequence: Synthetic polypeptide
  VH of XENP021028

SEQ ID NO: 30076 - protein, 5 aa, Artificial Sequence
  Description of Artificial Sequence: Synthetic peptide
  XENP021028 vhCDR1
DAWMD

SEQ ID NO: 30077 - protein, 19 aa, Artificial Sequence
  Description of Artificial Sequence: Synthetic peptide
  XENP021028 vhCDR2
EIRTKANNHLTYYAESVKG

SEQ ID NO: 30078 - protein, 10 aa, Artificial Sequence
  Description of Artificial Sequence: Synthetic peptide
  XENP021028 vhCDR3
LANWDWYFDV

SEQ ID NO: 30079 - protein, 218 aa, Artificial Sequence; identical to SEQ ID NO: 17590
  Description of Artificial Sequence: Synthetic polypeptide
  XENP021028 7G8_H0.93_L0_Fab Light Chain

SEQ ID NO: 30080 - protein, 111 aa, Artificial Sequence; identical to SEQ ID NO: 17591
  Description of Artificial Sequence: Synthetic polypeptide
  VL of XENP021028

SEQ ID NO: 30081 - protein, 15 aa, Artificial Sequence
  Description of Artificial Sequence: Synthetic peptide
  XENP021028 vlCDR1
KASQSVDYDGDSYMN

SEQ ID NO: 30082 - protein, 7 aa, Artificial Sequence
  Description of Artificial Sequence: Synthetic peptide
  XENP021028 vlCDR2
AASNLES

SEQ ID NO: 30083 - protein, 9 aa, Artificial Sequence
  Description of Artificial Sequence: Synthetic peptide
  XENP021028 vlCDR3
QQSNEDPFT

SEQ ID NO: 30084 - protein, 226 aa, Artificial Sequence
  Description of Artificial Sequence: Synthetic polypeptide
  XENP021029 7G8_H0.94_L0_Fab Heavy Chain
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30085 - protein, 121 aa, Artificial Sequence; identical to SEQ ID NO: 19146
  Description of Artificial Sequence: Synthetic polypeptide
  VH of XENP021029

SEQ ID NO: 30086 - protein, 5 aa, Artificial Sequence
  Description of Artificial Sequence: Synthetic peptide
  XENP021029 vhCDR1
DAWMD

SEQ ID NO: 30087 - protein, 19 aa, Artificial Sequence
  Description of Artificial Sequence: Synthetic peptide
  XENP021029 vhCDR2
EIRTKANNHKTYYAESVKG

SEQ ID NO: 30088 - protein, 10 aa, Artificial Sequence
  Description of Artificial Sequence: Synthetic peptide
  XENP021029 vhCDR3
LANWDWYFDV

SEQ ID NO: 30089 - protein, 218 aa, Artificial Sequence; identical to SEQ ID NO: 17590
  Description of Artificial Sequence: Synthetic polypeptide
  XENP021029 7G8_H0.94_L0_Fab Light Chain

SEQ ID NO: 30090 - protein, 111 aa, Artificial Sequence; identical to SEQ ID NO: 17591
  Description of Artificial Sequence: Synthetic polypeptide
  VL of XENP021029

SEQ ID NO: 30091 - protein, 15 aa, Artificial Sequence
  Description of Artificial Sequence: Synthetic peptide
  XENP021029 vlCDR1
KASQSVDYDGDSYMN

SEQ ID NO: 30092 - protein, 7 aa, Artificial Sequence
  Description of Artificial Sequence: Synthetic peptide
  XENP021029 vlCDR2
AASNLES

SEQ ID NO: 30093 - protein, 9 aa, Artificial Sequence
  Description of Artificial Sequence: Synthetic peptide
  XENP021029 vlCDR3
QQSNEDPFT

SEQ ID NO: 30094 - protein, 226 aa, Artificial Sequence
  Description of Artificial Sequence: Synthetic polypeptide
  XENP021030 7G8_H0.95_L0_Fab Heavy Chain
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30095 - protein, 121 aa, Artificial Sequence; identical to SEQ ID NO: 19156
  Description of Artificial Sequence: Synthetic polypeptide
  VH of XENP021030

SEQ ID NO: 30096 - protein, 5 aa, Artificial Sequence
  Description of Artificial Sequence: Synthetic peptide
  XENP021030 vhCDR1
DAWMD

SEQ ID NO: 30097 - protein, 19 aa, Artificial Sequence
  Description of Artificial Sequence: Synthetic peptide
  XENP021030 vhCDR2
EIRTKANNHYTYYAESVKG

SEQ ID NO: 30098 - protein, 10 aa, Artificial Sequence
  Description of Artificial Sequence: Synthetic peptide
  XENP021030 vhCDR3
LANWDWYFDV

SEQ ID NO: 30099 - protein, 218 aa, Artificial Sequence; identical to SEQ ID NO: 17590
  Description of Artificial Sequence: Synthetic polypeptide
  XENP021030 7G8_H0.95_L0_Fab Light Chain

SEQ ID NO: 30100 - protein, 111 aa, Artificial Sequence; identical to SEQ ID NO: 17591
  Description of Artificial Sequence: Synthetic polypeptide
  VL of XENP021030

SEQ ID NO: 30101 - protein, 15 aa, Artificial Sequence
  Description of Artificial Sequence: Synthetic peptide
  XENP021030 vlCDR1
KASQSVDYDGDSYMN

SEQ ID NO: 30102 - protein, 7 aa, Artificial Sequence
  Description of Artificial Sequence: Synthetic peptide
  XENP021030 vlCDR2
AASNLES

SEQ ID NO: 30103 - protein, 9 aa, Artificial Sequence
  Description of Artificial Sequence: Synthetic peptide
  XENP021030 vlCDR3
QQSNEDPFT

SEQ ID NO: 30104 - protein, 226 aa, Artificial Sequence
  Description of Artificial Sequence: Synthetic polypeptide
  XENP021031 7G8_H0.96_L0_Fab Heavy Chain
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30105 - protein, 121 aa, Artificial Sequence; identical to SEQ ID NO: 19166
  Description of Artificial Sequence: Synthetic polypeptide
  VH of XENP021031

SEQ ID NO: 30106 - protein, 5 aa, Artificial Sequence
  Description of Artificial Sequence: Synthetic peptide
  XENP021031 vhCDR1
DAWMD

SEQ ID NO: 30107 - protein, 19 aa, Artificial Sequence
  Description of Artificial Sequence: Synthetic peptide
  XENP021031 vhCDR2
EIRTKANNHATFYAESVKG

SEQ ID NO: 30108 - protein, 10 aa, Artificial Sequence
  Description of Artificial Sequence: Synthetic peptide
  XENP021031 vhCDR3
LANWDWYFDV

SEQ ID NO: 30109 - protein, 218 aa, Artificial Sequence; identical to SEQ ID NO: 17590
  Description of Artificial Sequence: Synthetic polypeptide
  XENP021031 7G8_H0.96_L0_Fab Light Chain

SEQ ID NO: 30110 - protein, 111 aa, Artificial Sequence; identical to SEQ ID NO: 17591
  Description of Artificial Sequence: Synthetic polypeptide
  VL of XENP021031

SEQ ID NO: 30111 - protein, 15 aa, Artificial Sequence
  Description of Artificial Sequence: Synthetic peptide
  XENP021031 vlCDR1
KASQSVDYDGDSYMN

SEQ ID NO: 30112 - protein, 7 aa, Artificial Sequence
  Description of Artificial Sequence: Synthetic peptide
  XENP021031 vlCDR2
AASNLES

SEQ ID NO: 30113 - protein, 9 aa, Artificial Sequence
  Description of Artificial Sequence: Synthetic peptide
  XENP021031 vlCDR3
QQSNEDPFT

SEQ ID NO: 30114 - protein, 226 aa, Artificial Sequence
  Description of Artificial Sequence: Synthetic polypeptide
  XENP021032 7G8_H0.97_L0_Fab Heavy Chain
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30115 - protein, 121 aa, Artificial Sequence; identical to SEQ ID NO: 19176
  Description of Artificial Sequence: Synthetic polypeptide
  VH of XENP021032

SEQ ID NO: 30116 - protein, 5 aa, Artificial Sequence
  Description of Artificial Sequence: Synthetic peptide
  XENP021032 vhCDR1
DAWMD

SEQ ID NO: 30117 - protein, 19 aa, Artificial Sequence
  Description of Artificial Sequence: Synthetic peptide
  XENP021032 vhCDR2
EIRTKANNHATHYAESVKG

SEQ ID NO: 30118 - protein, 10 aa, Artificial Sequence
  Description of Artificial Sequence: Synthetic peptide
  XENP021032 vhCDR3
LANWDWYFDV

SEQ ID NO: 30119 - protein, 218 aa, Artificial Sequence; identical to SEQ ID NO: 17590
  Description of Artificial Sequence: Synthetic polypeptide
  XENP021032 7G8_H0.97_L0_Fab Light Chain

SEQ ID NO: 30120 - protein, 111 aa, Artificial Sequence; identical to SEQ ID NO: 17591
  Description of Artificial Sequence: Synthetic polypeptide
  VL of XENP021032

SEQ ID NO: 30121 - protein, 15 aa, Artificial Sequence
  Description of Artificial Sequence: Synthetic peptide
  XENP021032 vlCDR1
KASQSVDYDGDSYMN

SEQ ID NO: 30122 - protein, 7 aa, Artificial Sequence
  Description of Artificial Sequence: Synthetic peptide
  XENP021032 vlCDR2
AASNLES

SEQ ID NO: 30123 - protein, 9 aa, Artificial Sequence
  Description of Artificial Sequence: Synthetic peptide
  XENP021032 vlCDR3
QQSNEDPFT

SEQ ID NO: 30124 - protein, 226 aa, Artificial Sequence
  Description of Artificial Sequence: Synthetic polypeptide
  XENP021033 7G8_H0.98_L0_Fab Heavy Chain
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30125 - protein, 121 aa, Artificial Sequence; identical to SEQ ID NO: 19186
  Description of Artificial Sequence: Synthetic polypeptide
  VH of XENP021033

SEQ ID NO: 30126 - protein, 5 aa, Artificial Sequence
  Description of Artificial Sequence: Synthetic peptide
  XENP021033 vhCDR1
DAWMD

SEQ ID NO: 30127 - protein, 19 aa, Artificial Sequence
  Description of Artificial Sequence: Synthetic peptide
  XENP021033 vhCDR2
EIRTKANNHATLYAESVKG

SEQ ID NO: 30128 - protein, 10 aa, Artificial Sequence
  Description of Artificial Sequence: Synthetic peptide
  XENP021033 vhCDR3
LANWDWYFDV

SEQ ID NO: 30129 - protein, 218 aa, Artificial Sequence; identical to SEQ ID NO: 17590
  Description of Artificial Sequence: Synthetic polypeptide
  XENP021033 7G8_H0.98_L0_Fab Light Chain

SEQ ID NO: 30130 - protein, 111 aa, Artificial Sequence; identical to SEQ ID NO: 17591
  Description of Artificial Sequence: Synthetic polypeptide
  VL of XENP021033

SEQ ID NO: 30131 - protein, 15 aa, Artificial Sequence
  Description of Artificial Sequence: Synthetic peptide
  XENP021033 vlCDR1
KASQSVDYDGDSYMN

SEQ ID NO: 30132 - protein, 7 aa, Artificial Sequence
  Description of Artificial Sequence: Synthetic peptide
  XENP021033 vlCDR2
AASNLES

SEQ ID NO: 30133 - protein, 9 aa, Artificial Sequence
  Description of Artificial Sequence: Synthetic peptide
  XENP021033 vlCDR3
QQSNEDPFT

SEQ ID NO: 30134 - protein, 226 aa, Artificial Sequence
  Description of Artificial Sequence: Synthetic polypeptide
  XENP021034 7G8_H0.99_L0_Fab Heavy Chain
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30135 - protein, 121 aa, Artificial Sequence; identical to SEQ ID NO: 19196
  Description of Artificial Sequence: Synthetic polypeptide
  VH of XENP021034

SEQ ID NO: 30136 - protein, 5 aa, Artificial Sequence
  Description of Artificial Sequence: Synthetic peptide
  XENP021034 vhCDR1
DAWMD

SEQ ID NO: 30137 - protein, 19 aa, Artificial Sequence
  Description of Artificial Sequence: Synthetic peptide
  XENP021034 vhCDR2
EIRTKANNHATWYAESVKG

SEQ ID NO: 30138 - protein, 10 aa, Artificial Sequence
  Description of Artificial Sequence: Synthetic peptide
  XENP021034 vhCDR3
LANWDWYFDV

SEQ ID NO: 30139 - protein, 218 aa, Artificial Sequence; identical to SEQ ID NO: 17590
  Description of Artificial Sequence: Synthetic polypeptide
  XENP021034 7G8_H0.99_L0_Fab Light Chain

SEQ ID NO: 30140 - protein, 111 aa, Artificial Sequence; identical to SEQ ID NO: 17591
  Description of Artificial Sequence: Synthetic polypeptide
  VL of XENP021034

SEQ ID NO: 30141 - protein, 15 aa, Artificial Sequence
  Description of Artificial Sequence: Synthetic peptide
  XENP021034 vlCDR1
KASQSVDYDGDSYMN

SEQ ID NO: 30142 - protein, 7 aa, Artificial Sequence
  Description of Artificial Sequence: Synthetic peptide
  XENP021034 vlCDR2
AASNLES

SEQ ID NO: 30143 - protein, 9 aa, Artificial Sequence
  Description of Artificial Sequence: Synthetic peptide
  XENP021034 vlCDR3
QQSNEDPFT

SEQ ID NO: 30144 - protein, 226 aa, Artificial Sequence
  Description of Artificial Sequence: Synthetic polypeptide
  XENP021035 7G8_H0.100_L0_Fab Heavy Chain
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30145 - protein, 121 aa, Artificial Sequence; identical to SEQ ID NO: 19206
  Description of Artificial Sequence: Synthetic polypeptide
  VH of XENP021035

SEQ ID NO: 30146 - protein, 5 aa, Artificial Sequence
  Description of Artificial Sequence: Synthetic peptide
  XENP021035 vhCDR1
DAWMD

SEQ ID NO: 30147 - protein, 19 aa, Artificial Sequence
  Description of Artificial Sequence: Synthetic peptide
  XENP021035 vhCDR2
EIRTKANNHATVYAESVKG

SEQ ID NO: 30148 - protein, 10 aa, Artificial Sequence
  Description of Artificial Sequence: Synthetic peptide
  XENP021035 vhCDR3
LANWDWYFDV

SEQ ID NO: 30149 - protein, 218 aa, Artificial Sequence; identical to SEQ ID NO: 17590
  Description of Artificial Sequence: Synthetic polypeptide
  XENP021035 7G8_H0.100_L0_Fab Light Chain

SEQ ID NO: 30150 - protein, 111 aa, Artificial Sequence; identical to SEQ ID NO: 17591
  Description of Artificial Sequence: Synthetic polypeptide
  VL of XENP021035

SEQ ID NO: 30151 - protein, 15 aa, Artificial Sequence
  Description of Artificial Sequence: Synthetic peptide
  XENP021035 vlCDR1
KASQSVDYDGDSYMN

SEQ ID NO: 30152 - protein, 7 aa, Artificial Sequence
  Description of Artificial Sequence: Synthetic peptide
  XENP021035 vlCDR2
AASNLES

SEQ ID NO: 30153 - protein, 9 aa, Artificial Sequence
  Description of Artificial Sequence: Synthetic peptide
  XENP021035 vlCDR3
QQSNEDPFT

SEQ ID NO: 30154 - protein, 226 aa, Artificial Sequence
  Description of Artificial Sequence: Synthetic polypeptide
  XENP021036 7G8_H0.101_L0_Fab Heavy Chain
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30155 - protein, 121 aa, Artificial Sequence; identical to SEQ ID NO: 19216
  Description of Artificial Sequence: Synthetic polypeptide
  VH of XENP021036

SEQ ID NO: 30156 - protein, 5 aa, Artificial Sequence
  Description of Artificial Sequence: Synthetic peptide
  XENP021036 vhCDR1
DAWMD

SEQ ID NO: 30157 - protein, 19 aa, Artificial Sequence
  Description of Artificial Sequence: Synthetic peptide
  XENP021036 vhCDR2
EIRTKANNHATAYAESVKG

SEQ ID NO: 30158 - protein, 10 aa, Artificial Sequence
  Description of Artificial Sequence: Synthetic peptide
  XENP021036 vhCDR3
LANWDWYFDV

SEQ ID NO: 30159 - protein, 218 aa, Artificial Sequence; identical to SEQ ID NO: 17590
  Description of Artificial Sequence: Synthetic polypeptide
  XENP021036 7G8_H0.101_L0_Fab Light Chain

SEQ ID NO: 30160 - protein, 111 aa, Artificial Sequence; identical to SEQ ID NO: 17591
  Description of Artificial Sequence: Synthetic polypeptide
  VL of XENP021036

SEQ ID NO: 30161 - protein, 15 aa, Artificial Sequence
  Description of Artificial Sequence: Synthetic peptide
  XENP021036 vlCDR1
KASQSVDYDGDSYMN

SEQ ID NO: 30162 - protein, 7 aa, Artificial Sequence
  Description of Artificial Sequence: Synthetic peptide
  XENP021036 vlCDR2
AASNLES

SEQ ID NO: 30163 - protein, 9 aa, Artificial Sequence
  Description of Artificial Sequence: Synthetic peptide
  XENP021036 vlCDR3
QQSNEDPFT

SEQ ID NO: 30164 - protein, 226 aa, Artificial Sequence
  Description of Artificial Sequence: Synthetic polypeptide
  XENP021037 7G8_H0.102_L0_Fab Heavy Chain
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30165 - protein, 121 aa, Artificial Sequence; identical to SEQ ID NO: 19226
  Description of Artificial Sequence: Synthetic polypeptide
  VH of XENP021037

SEQ ID NO: 30166 - protein, 5 aa, Artificial Sequence
  Description of Artificial Sequence: Synthetic peptide
  XENP021037 vhCDR1
DAWMD

SEQ ID NO: 30167 - protein, 19 aa, Artificial Sequence
  Description of Artificial Sequence: Synthetic peptide
  XENP021037 vhCDR2
EIRTKANNHATQYAESVKG

SEQ ID NO: 30168 - protein, 10 aa, Artificial Sequence
  Description of Artificial Sequence: Synthetic peptide
  XENP021037 vhCDR3
LANWDWYFDV

SEQ ID NO: 30169 - protein, 218 aa, Artificial Sequence; identical to SEQ ID NO: 17590
  Description of Artificial Sequence: Synthetic polypeptide
  XENP021037 7G8_H0.102_L0_Fab Light Chain

SEQ ID NO: 30170 - protein, 111 aa, Artificial Sequence; identical to SEQ ID NO: 17591
  Description of Artificial Sequence: Synthetic polypeptide
  VL of XENP021037

SEQ ID NO: 30171 - protein, 15 aa, Artificial Sequence
  Description of Artificial Sequence: Synthetic peptide
  XENP021037 vlCDR1
KASQSVDYDGDSYMN

SEQ ID NO: 30172 - protein, 7 aa, Artificial Sequence
  Description of Artificial Sequence: Synthetic peptide
  XENP021037 vlCDR2
AASNLES

SEQ ID NO: 30173 - protein, 9 aa, Artificial Sequence
  Description of Artificial Sequence: Synthetic peptide
  XENP021037 vlCDR3
QQSNEDPFT

SEQ ID NO: 30174 - protein, 226 aa, Artificial Sequence
  Description of Artificial Sequence: Synthetic polypeptide
  XENP021038 7G8_H0.103_L0_Fab Heavy Chain
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30175 - protein, 121 aa, Artificial Sequence; identical to SEQ ID NO: 19236
  Description of Artificial Sequence: Synthetic polypeptide
  VH of XENP021038

SEQ ID NO: 30176 - protein, 5 aa, Artificial Sequence
  Description of Artificial Sequence: Synthetic peptide
  XENP021038 vhCDR1
DAWMD

SEQ ID NO: 30177 - protein, 19 aa, Artificial Sequence
  Description of Artificial Sequence: Synthetic peptide
  XENP021038 vhCDR2
EIRTKANNHATDYAESVKG

SEQ ID NO: 30178 - protein, 10 aa, Artificial Sequence
  Description of Artificial Sequence: Synthetic peptide
  XENP021038 vhCDR3
LANWDWYFDV

SEQ ID NO: 30179 - protein, 218 aa, Artificial Sequence; identical to SEQ ID NO: 17590
  Description of Artificial Sequence: Synthetic polypeptide
  XENP021038 7G8_H0.103_L0_Fab Light Chain

SEQ ID NO: 30180 - protein, 111 aa, Artificial Sequence; identical to SEQ ID NO: 17591
  Description of Artificial Sequence: Synthetic polypeptide
  VL of XENP021038

SEQ ID NO: 30181 - protein, 15 aa, Artificial Sequence
  Description of Artificial Sequence: Synthetic peptide
  XENP021038 vlCDR1
KASQSVDYDGDSYMN

SEQ ID NO: 30182 - protein, 7 aa, Artificial Sequence
  Description of Artificial Sequence: Synthetic peptide
  XENP021038 vlCDR2
AASNLES

SEQ ID NO: 30183 - protein, 9 aa, Artificial Sequence
  Description of Artificial Sequence: Synthetic peptide
  XENP021038 vlCDR3
QQSNEDPFT

SEQ ID NO: 30184 - protein, 226 aa, Artificial Sequence
  Description of Artificial Sequence: Synthetic polypeptide
  XENP021039 7G8_H0.104_L0_Fab Heavy Chain
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30185 - protein, 121 aa, Artificial Sequence; identical to SEQ ID NO: 19246
  Description of Artificial Sequence: Synthetic polypeptide
  VH of XENP021039

SEQ ID NO: 30186 - protein, 5 aa, Artificial Sequence
  Description of Artificial Sequence: Synthetic peptide
  XENP021039 vhCDR1
DAWMD

SEQ ID NO: 30187 - protein, 19 aa, Artificial Sequence
  Description of Artificial Sequence: Synthetic peptide
  XENP021039 vhCDR2
EIRTKANNHATKYAESVKG

SEQ ID NO: 30188 - protein, 10 aa, Artificial Sequence
  Description of Artificial Sequence: Synthetic peptide
  XENP021039 vhCDR3
LANWDWYFDV

SEQ ID NO: 30189 - protein, 218 aa, Artificial Sequence; identical to SEQ ID NO: 17590
  Description of Artificial Sequence: Synthetic polypeptide
  XENP021039 7G8_H0.104_L0_Fab Light Chain

SEQ ID NO: 30190 - protein, 111 aa, Artificial Sequence; identical to SEQ ID NO: 17591
  Description of Artificial Sequence: Synthetic polypeptide
  VL of XENP021039

SEQ ID NO: 30191 - protein, 15 aa, Artificial Sequence
  Description of Artificial Sequence: Synthetic peptide
  XENP021039 vlCDR1
KASQSVDYDGDSYMN

SEQ ID NO: 30192 - protein, 7 aa, Artificial Sequence
  Description of Artificial Sequence: Synthetic peptide
  XENP021039 vlCDR2
AASNLES

SEQ ID NO: 30193 - protein, 9 aa, Artificial Sequence
  Description of Artificial Sequence: Synthetic peptide
  XENP021039 vlCDR3
QQSNEDPFT

SEQ ID NO: 30194 - protein, 226 aa, Artificial Sequence
  Description of Artificial Sequence: Synthetic polypeptide
  XENP021040 7G8_H0.105_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30195 - protein, 121 aa, Artificial Sequence; identical to SEQ ID NO: 19256
  Description of Artificial Sequence: Synthetic polypeptide
  VH of XENP021040

SEQ ID NO: 30196 - protein, 5 aa, Artificial Sequence
  Description of Artificial Sequence: Synthetic peptide
  XENP021040 vhCDR1
DAWMD

SEQ ID NO: 30197 - protein, 19 aa, Artificial Sequence
  Description of Artificial Sequence: Synthetic peptide
  XENP021040 vhCDR2
EIRTKANNHATYYAESVKG

SEQ ID NO: 30198 - protein, 10 aa, Artificial Sequence
  Description of Artificial Sequence: Synthetic peptide
  XENP021040 vhCDR3
IANWDWYFDV

SEQ ID NO: 30199 - protein, 218 aa, Artificial Sequence; identical to SEQ ID NO: 17590
  Description of Artificial Sequence: Synthetic polypeptide
  XENP021040 7G8_H0.105_L0_Fab Light Chain

SEQ ID NO: 30200 - protein, 111 aa, Artificial Sequence; identical to SEQ ID NO: 17591
  Description of Artificial Sequence: Synthetic polypeptide
  VL of XENP021040

SEQ ID NO: 30201 - protein, 15 aa, Artificial Sequence
  Description of Artificial Sequence: Synthetic peptide
  XENP021040 vlCDR1
KASQSVDYDGDSYMN

SEQ ID NO: 30202 - protein, 7 aa, Artificial Sequence
  Description of Artificial Sequence: Synthetic peptide
  XENP021040 vlCDR2
AASNLES

SEQ ID NO: 30203 - protein, 9 aa, Artificial Sequence
  Description of Artificial Sequence: Synthetic peptide
  XENP021040 vlCDR3
QQSNEDPFT

SEQ ID NO: 30204 - protein, 226 aa, Artificial Sequence
  Description of Artificial Sequence: Synthetic polypeptide
  XENP021041 7G8_H0.106_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30205 - protein, 121 aa, Artificial Sequence; identical to SEQ ID NO: 19266
  Description of Artificial Sequence: Synthetic polypeptide
  VH of XENP021041

SEQ ID NO: 30206 - protein, 5 aa, Artificial Sequence
  Description of Artificial Sequence: Synthetic peptide
  XENP021041 vhCDR1
DAWMD

SEQ ID NO: 30207 - protein, 19 aa, Artificial Sequence
  Description of Artificial Sequence: Synthetic peptide
  XENP021041 vhCDR2
EIRTKANNHATYYAESVKG

SEQ ID NO: 30208 - protein, 10 aa, Artificial Sequence
  Description of Artificial Sequence: Synthetic peptide
  XENP021041 vhCDR3
FANWDWYFDV

SEQ ID NO: 30209 - protein, 218 aa, Artificial Sequence; identical to SEQ ID NO: 17590
  Description of Artificial Sequence: Synthetic polypeptide
  XENP021041 7G8_H0.106_L0_Fab Light Chain

SEQ ID NO: 30210 - protein, 111 aa, Artificial Sequence; identical to SEQ ID NO: 17591
  Description of Artificial Sequence: Synthetic polypeptide
  VL of XENP021041

SEQ ID NO: 30211 - protein, 15 aa, Artificial Sequence
  Description of Artificial Sequence: Synthetic peptide
  XENP021041 vlCDR1
KASQSVDYDGDSYMN

SEQ ID NO: 30212 - protein, 7 aa, Artificial Sequence
  Description of Artificial Sequence: Synthetic peptide
  XENP021041 vlCDR2
AASNLES

SEQ ID NO: 30213 - protein, 9 aa, Artificial Sequence
  Description of Artificial Sequence: Synthetic peptide
  XENP021041 vlCDR3
QQSNEDPFT

SEQ ID NO: 30214 - protein, 226 aa, Artificial Sequence
  Description of Artificial Sequence: Synthetic polypeptide
  XENP021042 7G8_H0.107_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30215 - protein, 121 aa, Artificial Sequence; identical to SEQ ID NO: 19276
  Description of Artificial Sequence: Synthetic polypeptide
  VH of XENP021042

SEQ ID NO: 30216 - protein, 5 aa, Artificial Sequence
  Description of Artificial Sequence: Synthetic peptide
  XENP021042 vhCDR1
DAWMD

SEQ ID NO: 30217 - protein, 19 aa, Artificial Sequence
  Description of Artificial Sequence: Synthetic peptide
  XENP021042 vhCDR2
EIRTKANNHATYYAESVKG

SEQ ID NO: 30218 - protein, 10 aa, Artificial Sequence
  Description of Artificial Sequence: Synthetic peptide
  XENP021042 vhCDR3
VANWDWYFDV

SEQ ID NO: 30219 - protein, 218 aa, Artificial Sequence; identical to SEQ ID NO: 17590
  Description of Artificial Sequence: Synthetic polypeptide
  XENP021042 7G8_H0.107_L0_Fab Light Chain

SEQ ID NO: 30220 - protein, 111 aa, Artificial Sequence; identical to SEQ ID NO: 17591
  Description of Artificial Sequence: Synthetic polypeptide
  VL of XENP021042

SEQ ID NO: 30221 - protein, 15 aa, Artificial Sequence
  Description of Artificial Sequence: Synthetic peptide
  XENP021042 vlCDR1
KASQSVDYDGDSYMN

SEQ ID NO: 30222 - protein, 7 aa, Artificial Sequence
  Description of Artificial Sequence: Synthetic peptide
  XENP021042 vlCDR2
AASNLES

SEQ ID NO: 30223 - protein, 9 aa, Artificial Sequence
  Description of Artificial Sequence: Synthetic peptide
  XENP021042 vlCDR3
QQSNEDPFT

SEQ ID NO: 30224 - protein, 226 aa, Artificial Sequence
  Description of Artificial Sequence: Synthetic polypeptide
  XENP021043 7G8_H0.110_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30225 - protein, 121 aa, Artificial Sequence; identical to SEQ ID NO: 19306
  Description of Artificial Sequence: Synthetic polypeptide
  VH of XENP021043

SEQ ID NO: 30226 - protein, 5 aa, Artificial Sequence
  Description of Artificial Sequence: Synthetic peptide
  XENP021043 vhCDR1
DAWMD

SEQ ID NO: 30227 - protein, 19 aa, Artificial Sequence
  Description of Artificial Sequence: Synthetic peptide
  XENP021043 vhCDR2
EIRTKANNHATYYAESVKG

SEQ ID NO: 30228 - protein, 10 aa, Artificial Sequence
  Description of Artificial Sequence: Synthetic peptide
  XENP021043 vhCDR3
DANWDWYFDV

SEQ ID NO: 30229 - protein, 218 aa, Artificial Sequence; identical to SEQ ID NO: 17590
  Description of Artificial Sequence: Synthetic polypeptide
  XENP021043 7G8_H0.110_L0_Fab Light Chain

SEQ ID NO: 30230 - protein, 111 aa, Artificial Sequence; identical to SEQ ID NO: 17591
  Description of Artificial Sequence: Synthetic polypeptide
  VL of XENP021043

SEQ ID NO: 30231 - protein, 15 aa, Artificial Sequence
  Description of Artificial Sequence: Synthetic peptide
  XENP021043 vlCDR1
KASQSVDYDGDSYMN

SEQ ID NO: 30232 - protein, 7 aa, Artificial Sequence
  Description of Artificial Sequence: Synthetic peptide
  XENP021043 vlCDR2
AASNLES

SEQ ID NO: 30233 - protein, 9 aa, Artificial Sequence
  Description of Artificial Sequence: Synthetic peptide
  XENP021043 vlCDR3
QQSNEDPFT

SEQ ID NO: 30234 - protein, 226 aa, Artificial Sequence
  Description of Artificial Sequence: Synthetic polypeptide
  XENP021044 7G8_H0.111_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30235 - protein, 121 aa, Artificial Sequence; identical to SEQ ID NO: 19316
  Description of Artificial Sequence: Synthetic polypeptide
  VH of XENP021044

SEQ ID NO: 30236 - protein, 5 aa, Artificial Sequence
  Description of Artificial Sequence: Synthetic peptide
  XENP021044 vhCDR1
DAWMD

SEQ ID NO: 30237 - protein, 19 aa, Artificial Sequence
  Description of Artificial Sequence: Synthetic peptide
  XENP021044 vhCDR2
EIRTKANNHATYYAESVKG

SEQ ID NO: 30238 - protein, 10 aa, Artificial Sequence
  Description of Artificial Sequence: Synthetic peptide
  XENP021044 vhCDR3
AANWDWYFDV

SEQ ID NO: 30239 - protein, 218 aa, Artificial Sequence; identical to SEQ ID NO: 17590
  Description of Artificial Sequence: Synthetic polypeptide
  XENP021044 7G8_H0.111_L0_Fab Light Chain

SEQ ID NO: 30240 - protein, 111 aa, Artificial Sequence; identical to SEQ ID NO: 17591
  Description of Artificial Sequence: Synthetic polypeptide
  VL of XENP021044

SEQ ID NO: 30241 - protein, 15 aa, Artificial Sequence
  Description of Artificial Sequence: Synthetic peptide
  XENP021044 vlCDR1
KASQSVDYDGDSYMN

SEQ ID NO: 30242 - protein, 7 aa, Artificial Sequence
  Description of Artificial Sequence: Synthetic peptide
  XENP021044 vlCDR2
AASNLES

SEQ ID NO: 30243 - protein, 9 aa, Artificial Sequence
  Description of Artificial Sequence: Synthetic peptide
  XENP021044 vlCDR3
QQSNEDPFT

SEQ ID NO: 30244 - protein, 226 aa, Artificial Sequence
  Description of Artificial Sequence: Synthetic polypeptide
  XENP021045 7G8_H0.112_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30245 - protein, 121 aa, Artificial Sequence; identical to SEQ ID NO: 19326
  Description of Artificial Sequence: Synthetic polypeptide
  VH of XENP021045

SEQ ID NO: 30246 - protein, 5 aa, Artificial Sequence
  Description of Artificial Sequence: Synthetic peptide
  XENP021045 vhCDR1
DAWMD

SEQ ID NO: 30247 - protein, 19 aa, Artificial Sequence
  Description of Artificial Sequence: Synthetic peptide
  XENP021045 vhCDR2
EIRTKANNHATYYAESVKG

SEQ ID NO: 30248 - protein, 10 aa, Artificial Sequence
  Description of Artificial Sequence: Synthetic peptide
  XENP021045 vhCDR3
QANWDWYFDV

SEQ ID NO: 30249 - protein, 218 aa, Artificial Sequence; identical to SEQ ID NO: 17590
  Description of Artificial Sequence: Synthetic polypeptide
  XENP021045 7G8_H0.112_L0_Fab Light Chain

SEQ ID NO: 30250 - protein, 111 aa, Artificial Sequence; identical to SEQ ID NO: 17591
  Description of Artificial Sequence: Synthetic polypeptide
  VL of XENP021045

SEQ ID NO: 30251 - protein, 15 aa, Artificial Sequence
  Description of Artificial Sequence: Synthetic peptide
  XENP021045 vlCDR1
KASQSVDYDGDSYMN

SEQ ID NO: 30252 - protein, 7 aa, Artificial Sequence
  Description of Artificial Sequence: Synthetic peptide
  XENP021045 vlCDR2
AASNLES

SEQ ID NO: 30253 - protein, 9 aa, Artificial Sequence
  Description of Artificial Sequence: Synthetic peptide
  XENP021045 vlCDR3
QQSNEDPFT

SEQ ID NO: 30254 - protein, 226 aa, Artificial Sequence
  Description of Artificial Sequence: Synthetic polypeptide
  XENP021046 7G8_H0.114_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30255 - protein, 121 aa, Artificial Sequence; identical to SEQ ID NO: 19346
  Description of Artificial Sequence: Synthetic polypeptide
  VH of XENP021046

SEQ ID NO: 30256 - protein, 5 aa, Artificial Sequence
  Description of Artificial Sequence: Synthetic peptide
  XENP021046 vhCDR1
DAWMD

SEQ ID NO: 30257 - protein, 19 aa, Artificial Sequence
  Description of Artificial Sequence: Synthetic peptide
  XENP021046 vhCDR2
EIRTKANNHATYYAESVKG

SEQ ID NO: 30258 - protein, 10 aa, Artificial Sequence
  Description of Artificial Sequence: Synthetic peptide
  XENP021046 vhCDR3
LSNWDWYFDV

SEQ ID NO: 30259 - protein, 218 aa, Artificial Sequence; identical to SEQ ID NO: 17590
  Description of Artificial Sequence: Synthetic polypeptide
  XENP021046 7G8_H0.114_L0_Fab Light Chain

SEQ ID NO: 30260 - protein, 111 aa, Artificial Sequence; identical to SEQ ID NO: 17591
  Description of Artificial Sequence: Synthetic polypeptide
  VL of XENP021046

SEQ ID NO: 30261 - protein, 15 aa, Artificial Sequence
  Description of Artificial Sequence: Synthetic peptide
  XENP021046 vlCDR1
KASQSVDYDGDSYMN

SEQ ID NO: 30262 - protein, 7 aa, Artificial Sequence
  Description of Artificial Sequence: Synthetic peptide
  XENP021046 vlCDR2
AASNLES

SEQ ID NO: 30263 - protein, 9 aa, Artificial Sequence
  Description of Artificial Sequence: Synthetic peptide
  XENP021046 vlCDR3
QQSNEDPFT

SEQ ID NO: 30264 - protein, 226 aa, Artificial Sequence
  Description of Artificial Sequence: Synthetic polypeptide
  XENP021047 7G8_H0.115_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30265 - protein, 121 aa, Artificial Sequence; identical to SEQ ID NO: 19356
  Description of Artificial Sequence: Synthetic polypeptide
  VH of XENP021047

SEQ ID NO: 30266 - protein, 5 aa, Artificial Sequence
  Description of Artificial Sequence: Synthetic peptide
  XENP021047 vhCDR1
DAWMD

SEQ ID NO: 30267 - protein, 19 aa, Artificial Sequence
  Description of Artificial Sequence: Synthetic peptide
  XENP021047 vhCDR2
EIRTKANNHATYYAESVKG

SEQ ID NO: 30268 - protein, 10 aa, Artificial Sequence
  Description of Artificial Sequence: Synthetic peptide
  XENP021047 vhCDR3
LTNWDWYFDV

SEQ ID NO: 30269 - protein, 218 aa, Artificial Sequence; identical to SEQ ID NO: 17590
  Description of Artificial Sequence: Synthetic polypeptide
  XENP021047 7G8_H0.115_L0_Fab Light Chain

SEQ ID NO: 30270 - protein, 111 aa, Artificial Sequence; identical to SEQ ID NO: 17591
  Description of Artificial Sequence: Synthetic polypeptide
  VL of XENP021047

SEQ ID NO: 30271 - protein, 15 aa, Artificial Sequence
  Description of Artificial Sequence: Synthetic peptide
  XENP021047 vlCDR1
KASQSVDYDGDSYMN

SEQ ID NO: 30272 - protein, 7 aa, Artificial Sequence
  Description of Artificial Sequence: Synthetic peptide
  XENP021047 vlCDR2
AASNLES

SEQ ID NO: 30273 - protein, 9 aa, Artificial Sequence
  Description of Artificial Sequence: Synthetic peptide
  XENP021047 vlCDR3
QQSNEDPFT

SEQ ID NO: 30274 - protein, 226 aa, Artificial Sequence
  Description of Artificial Sequence: Synthetic polypeptide
  XENP021048 7G8_H0.116_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30275 - protein, 121 aa, Artificial Sequence; identical to SEQ ID NO: 19366
  Description of Artificial Sequence: Synthetic polypeptide
  VH of XENP021048

SEQ ID NO: 30276 - protein, 5 aa, Artificial Sequence
  Description of Artificial Sequence: Synthetic peptide
  XENP021048 vhCDR1
DAWMD

SEQ ID NO: 30277 - protein, 19 aa, Artificial Sequence
  Description of Artificial Sequence: Synthetic peptide
  XENP021048 vhCDR2
EIRTKANNHATYYAESVKG

SEQ ID NO: 30278 - protein, 10 aa, Artificial Sequence
  Description of Artificial Sequence: Synthetic peptide
  XENP021048 vhCDR3
LGNWDWYFDV

SEQ ID NO: 30279 - protein, 218 aa, Artificial Sequence; identical to SEQ ID NO: 17590
  Description of Artificial Sequence: Synthetic polypeptide
  XENP021048 7G8_H0.116_L0_Fab Light Chain

SEQ ID NO: 30280 - protein, 111 aa, Artificial Sequence; identical to SEQ ID NO: 17591
  Description of Artificial Sequence: Synthetic polypeptide
  VL of XENP021048

SEQ ID NO: 30281 - protein, 15 aa, Artificial Sequence
  Description of Artificial Sequence: Synthetic peptide
  XENP021048 vlCDR1
KASQSVDYDGDSYMN

SEQ ID NO: 30282 - protein, 7 aa, Artificial Sequence
  Description of Artificial Sequence: Synthetic peptide
  XENP021048 vlCDR2
AASNLES

SEQ ID NO: 30283 - protein, 9 aa, Artificial Sequence
  Description of Artificial Sequence: Synthetic peptide
  XENP021048 vlCDR3
QQSNEDPFT

SEQ ID NO: 30284 - protein, 226 aa, Artificial Sequence
  Description of Artificial Sequence: Synthetic polypeptide
  XENP021049 7G8_H0.117_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30285 - protein, 121 aa, Artificial Sequence; identical to SEQ ID NO: 19376
  Description of Artificial Sequence: Synthetic polypeptide
  VH of XENP021049

SEQ ID NO: 30286 - protein, 5 aa, Artificial Sequence
  Description of Artificial Sequence: Synthetic peptide
  XENP021049 vhCDR1
DAWMD

SEQ ID NO: 30287 - protein, 19 aa, Artificial Sequence
  Description of Artificial Sequence: Synthetic peptide
  XENP021049 vhCDR2
EIRTKANNHATYYAESVKG

SEQ ID NO: 30288 - protein, 10 aa, Artificial Sequence
  Description of Artificial Sequence: Synthetic peptide
  XENP021049 vhCDR3
LHNWDWYFDV

SEQ ID NO: 30289 - protein, 218 aa, Artificial Sequence; identical to SEQ ID NO: 17590
  Description of Artificial Sequence: Synthetic polypeptide
  XENP021049 7G8_H0.117_L0_Fab Light Chain

SEQ ID NO: 30290 - protein, 111 aa, Artificial Sequence; identical to SEQ ID NO: 17591
  Description of Artificial Sequence: Synthetic polypeptide
  VL of XENP021049

SEQ ID NO: 30291 - protein, 15 aa, Artificial Sequence
  Description of Artificial Sequence: Synthetic peptide
  XENP021049 vlCDR1
KASQSVDYDGDSYMN

SEQ ID NO: 30292 - protein, 7 aa, Artificial Sequence
  Description of Artificial Sequence: Synthetic peptide
  XENP021049 vlCDR2
AASNLES

SEQ ID NO: 30293 - protein, 9 aa, Artificial Sequence
  Description of Artificial Sequence: Synthetic peptide
  XENP021049 vlCDR3
QQSNEDPFT

SEQ ID NO: 30294 - protein, 226 aa, Artificial Sequence
  Description of Artificial Sequence: Synthetic polypeptide
  XENP021050 7G8_H0.118_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30295 - protein, 121 aa, Artificial Sequence; identical to SEQ ID NO: 19386
  Description of Artificial Sequence: Synthetic polypeptide
  VH of XENP021050

SEQ ID NO: 30296 - protein, 5 aa, Artificial Sequence
  Description of Artificial Sequence: Synthetic peptide
  XENP021050 vhCDR1
DAWMD

SEQ ID NO: 30297 - protein, 19 aa, Artificial Sequence
  Description of Artificial Sequence: Synthetic peptide
  XENP021050 vhCDR2
EIRTKANNHATYYAESVKG

SEQ ID NO: 30298 - protein, 10 aa, Artificial Sequence
  Description of Artificial Sequence: Synthetic peptide
  XENP021050 vhCDR3
LQNWDWYFDV

SEQ ID NO: 30299 - protein, 218 aa, Artificial Sequence; identical to SEQ ID NO: 17590
  Description of Artificial Sequence: Synthetic polypeptide
  XENP021050 7G8_H0.118_L0_Fab Light Chain

SEQ ID NO: 30300 - protein, 111 aa, Artificial Sequence; identical to SEQ ID NO: 17591
  Description of Artificial Sequence: Synthetic polypeptide
  VL of XENP021050

SEQ ID NO: 30301 - protein, 15 aa, Artificial Sequence
  Description of Artificial Sequence: Synthetic peptide
  XENP021050 vlCDR1
KASQSVDYDGDSYMN

SEQ ID NO: 30302 - protein, 7 aa, Artificial Sequence
  Description of Artificial Sequence: Synthetic peptide
  XENP021050 vlCDR2
AASNLES

SEQ ID NO: 30303 - protein, 9 aa, Artificial Sequence
  Description of Artificial Sequence: Synthetic peptide
  XENP021050 vlCDR3
QQSNEDPFT

SEQ ID NO: 30304 - protein, 226 aa, Artificial Sequence
  Description of Artificial Sequence: Synthetic polypeptide
  XENP021051 7G8_H0.119_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30305 - protein, 121 aa, Artificial Sequence; identical to SEQ ID NO: 19396
  Description of Artificial Sequence: Synthetic polypeptide
  VH of XENP021051

SEQ ID NO: 30306 - protein, 5 aa, Artificial Sequence
  Description of Artificial Sequence: Synthetic peptide
  XENP021051 vhCDR1
DAWMD

SEQ ID NO: 30307 - protein, 19 aa, Artificial Sequence
  Description of Artificial Sequence: Synthetic peptide
  XENP021051 vhCDR2
EIRTKANNHATYYAESVKG

SEQ ID NO: 30308 - protein, 10 aa, Artificial Sequence
  Description of Artificial Sequence: Synthetic peptide
  XENP021051 vhCDR3
LDNWDWYFDV

SEQ ID NO: 30309 - protein, 218 aa, Artificial Sequence; identical to SEQ ID NO: 17590
  Description of Artificial Sequence: Synthetic polypeptide
  XENP021051 7G8_H0.119_L0_Fab Light Chain

SEQ ID NO: 30310 - protein, 111 aa, Artificial Sequence; identical to SEQ ID NO: 17591
  Description of Artificial Sequence: Synthetic polypeptide
  VL of XENP021051

SEQ ID NO: 30311 - protein, 15 aa, Artificial Sequence
  Description of Artificial Sequence: Synthetic peptide
  XENP021051 vlCDR1
KASQSVDYDGDSYMN

SEQ ID NO: 30312 - protein, 7 aa, Artificial Sequence
  Description of Artificial Sequence: Synthetic peptide
  XENP021051 vlCDR2
AASNLES

SEQ ID NO: 30313 - protein, 9 aa, Artificial Sequence
  Description of Artificial Sequence: Synthetic peptide
  XENP021051 vlCDR3
QQSNEDPFT

SEQ ID NO: 30314 - protein, 226 aa, Artificial Sequence
  Description of Artificial Sequence: Synthetic polypeptide
  XENP021052 7G8_H0.120_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30315 - protein, 121 aa, Artificial Sequence; identical to SEQ ID NO: 19406
  Description of Artificial Sequence: Synthetic polypeptide
  VH of XENP021052

SEQ ID NO: 30316 - protein, 5 aa, Artificial Sequence
  Description of Artificial Sequence: Synthetic peptide
  XENP021052 vhCDR1
DAWMD

SEQ ID NO: 30317 - protein, 19 aa, Artificial Sequence
  Description of Artificial Sequence: Synthetic peptide
  XENP021052 vhCDR2
EIRTKANNHATYYAESVKG

SEQ ID NO: 30318 - protein, 10 aa, Artificial Sequence
  Description of Artificial Sequence: Synthetic peptide
  XENP021052 vhCDR3
LLNWDWYFDV

SEQ ID NO: 30319 - protein, 218 aa, Artificial Sequence; identical to SEQ ID NO: 17590
  Description of Artificial Sequence: Synthetic polypeptide
  XENP021052 7G8_H0.120_L0_Fab Light Chain

SEQ ID NO: 30320 - protein, 111 aa, Artificial Sequence; identical to SEQ ID NO: 17591
  Description of Artificial Sequence: Synthetic polypeptide
  VL of XENP021052

SEQ ID NO: 30321 - protein, 15 aa, Artificial Sequence
  Description of Artificial Sequence: Synthetic peptide
  XENP021052 vlCDR1
KASQSVDYDGDSYMN

SEQ ID NO: 30322 - protein, 7 aa, Artificial Sequence
  Description of Artificial Sequence: Synthetic peptide
  XENP021052 vlCDR2
AASNLES

SEQ ID NO: 30323 - protein, 9 aa, Artificial Sequence
  Description of Artificial Sequence: Synthetic peptide
  XENP021052 vlCDR3
QQSNEDPFT

SEQ ID NO: 30324 - protein, 226 aa, Artificial Sequence
  Description of Artificial Sequence: Synthetic polypeptide
  XENP021053 7G8_H0.121_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30325 - protein, 121 aa, Artificial Sequence; identical to SEQ ID NO: 19416
  Description of Artificial Sequence: Synthetic polypeptide
  VH of XENP021053

SEQ ID NO: 30326 - protein, 5 aa, Artificial Sequence
  Description of Artificial Sequence: Synthetic peptide
  XENP021053 vhCDR1
DAWMD

SEQ ID NO: 30327 - protein, 19 aa, Artificial Sequence
  Description of Artificial Sequence: Synthetic peptide
  XENP021053 vhCDR2
EIRTKANNHATYYAESVKG

SEQ ID NO: 30328 - protein, 10 aa, Artificial Sequence
  Description of Artificial Sequence: Synthetic peptide
  XENP021053 vhCDR3
LKNWDWYFDV

SEQ ID NO: 30329 - protein, 218 aa, Artificial Sequence; identical to SEQ ID NO: 17590
  Description of Artificial Sequence: Synthetic polypeptide
  XENP021053 7G8_H0.121_L0_Fab Light Chain

SEQ ID NO: 30330 - protein, 111 aa, Artificial Sequence; identical to SEQ ID NO: 17591
  Description of Artificial Sequence: Synthetic polypeptide
  VL of XENP021053

SEQ ID NO: 30331 - protein, 15 aa, Artificial Sequence
  Description of Artificial Sequence: Synthetic peptide
  XENP021053 vlCDR1
KASQSVDYDGDSYMN

SEQ ID NO: 30332 - protein, 7 aa, Artificial Sequence
  Description of Artificial Sequence: Synthetic peptide
  XENP021053 vlCDR2
AASNLES

SEQ ID NO: 30333 - protein, 9 aa, Artificial Sequence
  Description of Artificial Sequence: Synthetic peptide
  XENP021053 vlCDR3
QQSNEDPFT

SEQ ID NO: 30334 - protein, 226 aa, Artificial Sequence
  Description of Artificial Sequence: Synthetic polypeptide
  XENP021054 7G8_H0.122_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30335 - protein, 121 aa, Artificial Sequence; identical to SEQ ID NO: 19426
  Description of Artificial Sequence: Synthetic polypeptide
  VH of XENP021054

SEQ ID NO: 30336 - protein, 5 aa, Artificial Sequence
  Description of Artificial Sequence: Synthetic peptide
  XENP021054 vhCDR1
DAWMD

SEQ ID NO: 30337 - protein, 19 aa, Artificial Sequence
  Description of Artificial Sequence: Synthetic peptide
  XENP021054 vhCDR2
EIRTKANNHATYYAESVKG

SEQ ID NO: 30338 - protein, 10 aa, Artificial Sequence
  Description of Artificial Sequence: Synthetic peptide
  XENP021054 vhCDR3
LYNWDWYFDV

SEQ ID NO: 30339 - protein, 218 aa, Artificial Sequence; identical to SEQ ID NO: 17590
  Description of Artificial Sequence: Synthetic polypeptide
  XENP021054 7G8_H0.122_L0_Fab Light Chain

SEQ ID NO: 30340 - protein, 111 aa, Artificial Sequence; identical to SEQ ID NO: 17591
  Description of Artificial Sequence: Synthetic polypeptide
  VL of XENP021054

SEQ ID NO: 30341 - protein, 15 aa, Artificial Sequence
  Description of Artificial Sequence: Synthetic peptide
  XENP021054 vlCDR1
KASQSVDYDGDSYMN

SEQ ID NO: 30342 - protein, 7 aa, Artificial Sequence
  Description of Artificial Sequence: Synthetic peptide
  XENP021054 vlCDR2
AASNLES

SEQ ID NO: 30343 - protein, 9 aa, Artificial Sequence
  Description of Artificial Sequence: Synthetic peptide
  XENP021054 vlCDR3
QQSNEDPFT

SEQ ID NO: 30344 - protein, 226 aa, Artificial Sequence
  Description of Artificial Sequence: Synthetic polypeptide
  XENP021055 7G8_H0.123_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30345 - protein, 121 aa, Artificial Sequence; identical to SEQ ID NO: 19436
  Description of Artificial Sequence: Synthetic polypeptide
  VH of XENP021055

SEQ ID NO: 30346 - protein, 5 aa, Artificial Sequence
  Description of Artificial Sequence: Synthetic peptide
  XENP021055 vhCDR1
DAWMD

SEQ ID NO: 30347 - protein, 19 aa, Artificial Sequence
  Description of Artificial Sequence: Synthetic peptide
  XENP021055 vhCDR2
EIRTKANNHATYYAESVKG

SEQ ID NO: 30348 - protein, 10 aa, Artificial Sequence
  Description of Artificial Sequence: Synthetic peptide
  XENP021055 vhCDR3
LADWDWYFDV

SEQ ID NO: 30349 - protein, 218 aa, Artificial Sequence; identical to SEQ ID NO: 17590
  Description of Artificial Sequence: Synthetic polypeptide
  XENP021055 7G8_H0.123_L0_Fab Light Chain

SEQ ID NO: 30350 - protein, 111 aa, Artificial Sequence; identical to SEQ ID NO: 17591
  Description of Artificial Sequence: Synthetic polypeptide
  VL of XENP021055

SEQ ID NO: 30351 - protein, 15 aa, Artificial Sequence
  Description of Artificial Sequence: Synthetic peptide
  XENP021055 vlCDR1
KASQSVDYDGDSYMN

SEQ ID NO: 30352 - protein, 7 aa, Artificial Sequence
  Description of Artificial Sequence: Synthetic peptide
  XENP021055 vlCDR2
AASNLES

SEQ ID NO: 30353 - protein, 9 aa, Artificial Sequence
  Description of Artificial Sequence: Synthetic peptide
  XENP021055 vlCDR3
QQSNEDPFT

SEQ ID NO: 30354 - protein, 226 aa, Artificial Sequence
  Description of Artificial Sequence: Synthetic polypeptide
  XENP021056 7G8_H0.124_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30355 - protein, 121 aa, Artificial Sequence; identical to SEQ ID NO: 19446
  Description of Artificial Sequence: Synthetic polypeptide
  VH of XENP021056

SEQ ID NO: 30356 - protein, 5 aa, Artificial Sequence
  Description of Artificial Sequence: Synthetic peptide
  XENP021056 vhCDR1
DAWMD

SEQ ID NO: 30357 - protein, 19 aa, Artificial Sequence
  Description of Artificial Sequence: Synthetic peptide
  XENP021056 vhCDR2
EIRTKANNHATYYAESVKG

SEQ ID NO: 30358 - protein, 10 aa, Artificial Sequence
  Description of Artificial Sequence: Synthetic peptide
  XENP021056 vhCDR3
LAHWDWYFDV

SEQ ID NO: 30359 - protein, 218 aa, Artificial Sequence; identical to SEQ ID NO: 17590
  Description of Artificial Sequence: Synthetic polypeptide
  XENP021056 7G8_H0.124_L0_Fab Light Chain

SEQ ID NO: 30360 - protein, 111 aa, Artificial Sequence; identical to SEQ ID NO: 17591
  Description of Artificial Sequence: Synthetic polypeptide
  VL of XENP021056

SEQ ID NO: 30361 - protein, 15 aa, Artificial Sequence
  Description of Artificial Sequence: Synthetic peptide
  XENP021056 vlCDR1
KASQSVDYDGDSYMN

SEQ ID NO: 30362 - protein, 7 aa, Artificial Sequence
  Description of Artificial Sequence: Synthetic peptide
  XENP021056 vlCDR2
AASNLES

SEQ ID NO: 30363 - protein, 9 aa, Artificial Sequence
  Description of Artificial Sequence: Synthetic peptide
  XENP021056 vlCDR3
QQSNEDPFT

SEQ ID NO: 30364 - protein, 226 aa, Artificial Sequence
  Description of Artificial Sequence: Synthetic polypeptide
  XENP021057 7G8_H0.125_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30365 - protein, 121 aa, Artificial Sequence; identical to SEQ ID NO: 19456
  Description of Artificial Sequence: Synthetic polypeptide
  VH of XENP021057

SEQ ID NO: 30366 - protein, 5 aa, Artificial Sequence
  Description of Artificial Sequence: Synthetic peptide
  XENP021057 vhCDR1
DAWMD

SEQ ID NO: 30367 - protein, 19 aa, Artificial Sequence
  Description of Artificial Sequence: Synthetic peptide
  XENP021057 vhCDR2
EIRTKANNHATYYAESVKG

SEQ ID NO: 30368 - protein, 10 aa, Artificial Sequence
  Description of Artificial Sequence: Synthetic peptide
  XENP021057 vhCDR3
LAEWDWYFDV

SEQ ID NO: 30369 - protein, 218 aa, Artificial Sequence; identical to SEQ ID NO: 17590
  Description of Artificial Sequence: Synthetic polypeptide
  XENP021057 7G8_H0.125_L0_Fab Light Chain

SEQ ID NO: 30370 - protein, 111 aa, Artificial Sequence; identical to SEQ ID NO: 17591
  Description of Artificial Sequence: Synthetic polypeptide
  VL of XENP021057

SEQ ID NO: 30371 - protein, 15 aa, Artificial Sequence
  Description of Artificial Sequence: Synthetic peptide
  XENP021057 vlCDR1
KASQSVDYDGDSYMN

SEQ ID NO: 30372 - protein, 7 aa, Artificial Sequence
  Description of Artificial Sequence: Synthetic peptide
  XENP021057 vlCDR2
AASNLES

SEQ ID NO: 30373 - protein, 9 aa, Artificial Sequence
  Description of Artificial Sequence: Synthetic peptide
  XENP021057 vlCDR3
QQSNEDPFT

SEQ ID NO: 30374 - protein, 226 aa, Artificial Sequence
  Description of Artificial Sequence: Synthetic polypeptide
  XENP021058 7G8_H0.126_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30375 - protein, 121 aa, Artificial Sequence; identical to SEQ ID NO: 19466
  Description of Artificial Sequence: Synthetic polypeptide
  VH of XENP021058

SEQ ID NO: 30376 - protein, 5 aa, Artificial Sequence
  Description of Artificial Sequence: Synthetic peptide
  XENP021058 vhCDR1
DAWMD

SEQ ID NO: 30377 - protein, 19 aa, Artificial Sequence
  Description of Artificial Sequence: Synthetic peptide
  XENP021058 vhCDR2
EIRTKANNHATYYAESVKG

SEQ ID NO: 30378 - protein, 10 aa, Artificial Sequence
  Description of Artificial Sequence: Synthetic peptide
  XENP021058 vhCDR3
LASWDWYFDV

SEQ ID NO: 30379 - protein, 218 aa, Artificial Sequence; identical to SEQ ID NO: 17590
  Description of Artificial Sequence: Synthetic polypeptide
  XENP021058 7G8_H0.126_L0_Fab Light Chain

SEQ ID NO: 30380 - protein, 111 aa, Artificial Sequence; identical to SEQ ID NO: 17591
  Description of Artificial Sequence: Synthetic polypeptide
  VL of XENP021058

SEQ ID NO: 30381 - protein, 15 aa, Artificial Sequence
  Description of Artificial Sequence: Synthetic peptide
  XENP021058 vlCDR1
KASQSVDYDGDSYMN

SEQ ID NO: 30382 - protein, 7 aa, Artificial Sequence
  Description of Artificial Sequence: Synthetic peptide
  XENP021058 vlCDR2
AASNLES

SEQ ID NO: 30383 - protein, 9 aa, Artificial Sequence
  Description of Artificial Sequence: Synthetic peptide
  XENP021058 vlCDR3
QQSNEDPFT

SEQ ID NO: 30384 - protein, 226 aa, Artificial Sequence
  Description of Artificial Sequence: Synthetic polypeptide
  XENP021059 7G8_H0.127_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30385 - protein, 121 aa, Artificial Sequence; identical to SEQ ID NO: 19476
  Description of Artificial Sequence: Synthetic polypeptide
  VH of XENP021059

SEQ ID NO: 30386 - protein, 5 aa, Artificial Sequence
  Description of Artificial Sequence: Synthetic peptide
  XENP021059 vhCDR1
DAWMD

SEQ ID NO: 30387 - protein, 19 aa, Artificial Sequence
  Description of Artificial Sequence: Synthetic peptide
  XENP021059 vhCDR2
EIRTKANNHATYYAESVKG

SEQ ID NO: 30388 - protein, 10 aa, Artificial Sequence
  Description of Artificial Sequence: Synthetic peptide
  XENP021059 vhCDR3
LARWDWYFDV

SEQ ID NO: 30389 - protein, 218 aa, Artificial Sequence; identical to SEQ ID NO: 17590
  Description of Artificial Sequence: Synthetic polypeptide
  XENP021059 7G8_H0.127_L0_Fab Light Chain

SEQ ID NO: 30390 - protein, 111 aa, Artificial Sequence; identical to SEQ ID NO: 17591
  Description of Artificial Sequence: Synthetic polypeptide
  VL of XENP021059

SEQ ID NO: 30391 - protein, 15 aa, Artificial Sequence
  Description of Artificial Sequence: Synthetic peptide
  XENP021059 vlCDR1
KASQSVDYDGDSYMN

SEQ ID NO: 30392 - protein, 7 aa, Artificial Sequence
  Description of Artificial Sequence: Synthetic peptide
  XENP021059 vlCDR2
AASNLES

SEQ ID NO: 30393 - protein, 9 aa, Artificial Sequence
  Description of Artificial Sequence: Synthetic peptide
  XENP021059 vlCDR3
QQSNEDPFT

SEQ ID NO: 30394 - protein, 226 aa, Artificial Sequence
  Description of Artificial Sequence: Synthetic polypeptide
  XENP021060 7G8_H0.128_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30395 - protein, 121 aa, Artificial Sequence; identical to SEQ ID NO: 19486
  Description of Artificial Sequence: Synthetic polypeptide
  VH of XENP021060

SEQ ID NO: 30396 - protein, 5 aa, Artificial Sequence
  Description of Artificial Sequence: Synthetic peptide
  XENP021060 vhCDR1
DAWMD

SEQ ID NO: 30397 - protein, 19 aa, Artificial Sequence
  Description of Artificial Sequence: Synthetic peptide
  XENP021060 vhCDR2
EIRTKANNHATYYAESVKG

SEQ ID NO: 30398 - protein, 10 aa, Artificial Sequence
  Description of Artificial Sequence: Synthetic peptide
  XENP021060 vhCDR3
LALWDWYFDV

SEQ ID NO: 30399 - protein, 218 aa, Artificial Sequence; identical to SEQ ID NO: 17590
  Description of Artificial Sequence: Synthetic polypeptide
  XENP021060 7G8_H0.128_L0_Fab Light Chain

SEQ ID NO: 30400 - protein, 111 aa, Artificial Sequence; identical to SEQ ID NO: 17591
  Description of Artificial Sequence: Synthetic polypeptide
  VL of XENP021060

SEQ ID NO: 30401 - protein, 15 aa, Artificial Sequence
  Description of Artificial Sequence: Synthetic peptide
  XENP021060 vlCDR1
KASQSVDYDGDSYMN

SEQ ID NO: 30402 - protein, 7 aa, Artificial Sequence
  Description of Artificial Sequence: Synthetic peptide
  XENP021060 vlCDR2
AASNLES

SEQ ID NO: 30403 - protein, 9 aa, Artificial Sequence
  Description of Artificial Sequence: Synthetic peptide
  XENP021060 vlCDR3
QQSNEDPFT

SEQ ID NO: 30404 - protein, 226 aa, Artificial Sequence
  Description of Artificial Sequence: Synthetic polypeptide
  XENP021061 7G8_H0.129_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30405 - protein, 121 aa, Artificial Sequence; identical to SEQ ID NO: 19496
  Description of Artificial Sequence: Synthetic polypeptide
  VH of XENP021061

SEQ ID NO: 30406 - protein, 5 aa, Artificial Sequence
  Description of Artificial Sequence: Synthetic peptide
  XENP021061 vhCDR1
DAWMD

SEQ ID NO: 30407 - protein, 19 aa, Artificial Sequence
  Description of Artificial Sequence: Synthetic peptide
  XENP021061 vhCDR2
EIRTKANNHATYYAESVKG

SEQ ID NO: 30408 - protein, 10 aa, Artificial Sequence
  Description of Artificial Sequence: Synthetic peptide
  XENP021061 vhCDR3
LATWDWYFDV

SEQ ID NO: 30409 - protein, 218 aa, Artificial Sequence; identical to SEQ ID NO: 17590
  Description of Artificial Sequence: Synthetic polypeptide
  XENP021061 7G8_H0.129_L0_Fab Light Chain

SEQ ID NO: 30410 - protein, 111 aa, Artificial Sequence; identical to SEQ ID NO: 17591
  Description of Artificial Sequence: Synthetic polypeptide
  VL of XENP021061

SEQ ID NO: 30411 - protein, 15 aa, Artificial Sequence
  Description of Artificial Sequence: Synthetic peptide
  XENP021061 vlCDR1
KASQSVDYDGDSYMN

SEQ ID NO: 30412 - protein, 7 aa, Artificial Sequence
  Description of Artificial Sequence: Synthetic peptide
  XENP021061 vlCDR2
AASNLES

SEQ ID NO: 30413 - protein, 9 aa, Artificial Sequence
  Description of Artificial Sequence: Synthetic peptide
  XENP021061 vlCDR3
QQSNEDPFT

SEQ ID NO: 30414 - protein, 226 aa, Artificial Sequence
  Description of Artificial Sequence: Synthetic polypeptide
  XENP021062 7G8_H0.130_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30415 - protein, 121 aa, Artificial Sequence; identical to SEQ ID NO: 19506
  Description of Artificial Sequence: Synthetic polypeptide
  VH of XENP021062

SEQ ID NO: 30416 - protein, 5 aa, Artificial Sequence
  Description of Artificial Sequence: Synthetic peptide
  XENP021062 vhCDR1
DAWMD

SEQ ID NO: 30417 - protein, 19 aa, Artificial Sequence
  Description of Artificial Sequence: Synthetic peptide
  XENP021062 vhCDR2
EIRTKANNHATYYAESVKG

SEQ ID NO: 30418 - protein, 10 aa, Artificial Sequence
  Description of Artificial Sequence: Synthetic peptide
  XENP021062 vhCDR3
LAGWDWYFDV

SEQ ID NO: 30419 - protein, 218 aa, Artificial Sequence; identical to SEQ ID NO: 17590
  Description of Artificial Sequence: Synthetic polypeptide
  XENP021062 7G8_H0.130_L0_Fab Light Chain

SEQ ID NO: 30420 - protein, 111 aa, Artificial Sequence; identical to SEQ ID NO: 17591
  Description of Artificial Sequence: Synthetic polypeptide
  VL of XENP021062

SEQ ID NO: 30421 - protein, 15 aa, Artificial Sequence
  Description of Artificial Sequence: Synthetic peptide
  XENP021062 vlCDR1
KASQSVDYDGDSYMN

SEQ ID NO: 30422 - protein, 7 aa, Artificial Sequence
  Description of Artificial Sequence: Synthetic peptide
  XENP021062 vlCDR2
AASNLES

SEQ ID NO: 30423 - protein, 9 aa, Artificial Sequence
  Description of Artificial Sequence: Synthetic peptide
  XENP021062 vlCDR3
QQSNEDPFT

SEQ ID NO: 30424 - protein, 226 aa, Artificial Sequence
  Description of Artificial Sequence: Synthetic polypeptide
  XENP021063 7G8_H0.131_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30425 - protein, 121 aa, Artificial Sequence; identical to SEQ ID NO: 19516
  Description of Artificial Sequence: Synthetic polypeptide
  VH of XENP021063

SEQ ID NO: 30426 - protein, 5 aa, Artificial Sequence
  Description of Artificial Sequence: Synthetic peptide
  XENP021063 vhCDR1
DAWMD

SEQ ID NO: 30427 - protein, 19 aa, Artificial Sequence
  Description of Artificial Sequence: Synthetic peptide
  XENP021063 vhCDR2
EIRTKANNHATYYAESVKG

SEQ ID NO: 30428 - protein, 10 aa, Artificial Sequence
  Description of Artificial Sequence: Synthetic peptide
  XENP021063 vhCDR3
LAYWDWYFDV

SEQ ID NO: 30429 - protein, 218 aa, Artificial Sequence; identical to SEQ ID NO: 17590
  Description of Artificial Sequence: Synthetic polypeptide
  XENP021063 7G8_H0.131_L0_Fab Light Chain

SEQ ID NO: 30430 - protein, 111 aa, Artificial Sequence; identical to SEQ ID NO: 17591
  Description of Artificial Sequence: Synthetic polypeptide
  VL of XENP021063

SEQ ID NO: 30431 - protein, 15 aa, Artificial Sequence
  Description of Artificial Sequence: Synthetic peptide
  XENP021063 vlCDR1
KASQSVDYDGDSYMN

SEQ ID NO: 30432 - protein, 7 aa, Artificial Sequence
  Description of Artificial Sequence: Synthetic peptide
  XENP021063 vlCDR2
AASNLES

SEQ ID NO: 30433 - protein, 9 aa, Artificial Sequence
  Description of Artificial Sequence: Synthetic peptide
  XENP021063 vlCDR3
QQSNEDPFT

SEQ ID NO: 30434 - protein, 226 aa, Artificial Sequence
  Description of Artificial Sequence: Synthetic polypeptide
  XENP021064 7G8_H0.132_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30435 - protein, 121 aa, Artificial Sequence; identical to SEQ ID NO: 19526
  Description of Artificial Sequence: Synthetic polypeptide
  VH of XENP021064

SEQ ID NO: 30436 - protein, 5 aa, Artificial Sequence
  Description of Artificial Sequence: Synthetic peptide
  XENP021064 vhCDR1
DAWMD

SEQ ID NO: 30437 - protein, 19 aa, Artificial Sequence
  Description of Artificial Sequence: Synthetic peptide
  XENP021064 vhCDR2
EIRTKANNHATYYAESVKG

SEQ ID NO: 30438 - protein, 10 aa, Artificial Sequence
  Description of Artificial Sequence: Synthetic peptide
  XENP021064 vhCDR3
LANFDWYFDV

SEQ ID NO: 30439 - protein, 218 aa, Artificial Sequence; identical to SEQ ID NO: 17590
  Description of Artificial Sequence: Synthetic polypeptide
  XENP021064 7G8_H0.132_L0_Fab Light Chain

SEQ ID NO: 30440 - protein, 111 aa, Artificial Sequence; identical to SEQ ID NO: 17591
  Description of Artificial Sequence: Synthetic polypeptide
  VL of XENP021064

SEQ ID NO: 30441 - protein, 15 aa, Artificial Sequence
  Description of Artificial Sequence: Synthetic peptide
  XENP021064 vlCDR1
KASQSVDYDGDSYMN

SEQ ID NO: 30442 - protein, 7 aa, Artificial Sequence
  Description of Artificial Sequence: Synthetic peptide
  XENP021064 vlCDR2
AASNLES

SEQ ID NO: 30443 - protein, 9 aa, Artificial Sequence
  Description of Artificial Sequence: Synthetic peptide
  XENP021064 vlCDR3
QQSNEDPFT

SEQ ID NO: 30444 - protein, 226 aa, Artificial Sequence
  Description of Artificial Sequence: Synthetic polypeptide
  XENP021065 7G8_H0.134_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30445 - protein, 121 aa, Artificial Sequence; identical to SEQ ID NO: 19546
  Description of Artificial Sequence: Synthetic polypeptide
  VH of XENP021065

SEQ ID NO: 30446 - protein, 5 aa, Artificial Sequence
  Description of Artificial Sequence: Synthetic peptide
  XENP021065 vhCDR1
DAWMD

SEQ ID NO: 30447 - protein, 19 aa, Artificial Sequence
  Description of Artificial Sequence: Synthetic peptide
  XENP021065 vhCDR2
EIRTKANNHATYYAESVKG

SEQ ID NO: 30448 - protein, 10 aa, Artificial Sequence
  Description of Artificial Sequence: Synthetic peptide
  XENP021065 vhCDR3
LANYDWYFDV

SEQ ID NO: 30449 - protein, 218 aa, Artificial Sequence; identical to SEQ ID NO: 17590
  Description of Artificial Sequence: Synthetic polypeptide
  XENP021065 7G8_H0.134_L0_Fab Light Chain

SEQ ID NO: 30450 - protein, 111 aa, Artificial Sequence; identical to SEQ ID NO: 17591
  Description of Artificial Sequence: Synthetic polypeptide
  VL of XENP021065

SEQ ID NO: 30451 - protein, 15 aa, Artificial Sequence
  Description of Artificial Sequence: Synthetic peptide
  XENP021065 vlCDR1
KASQSVDYDGDSYMN

SEQ ID NO: 30452 - protein, 7 aa, Artificial Sequence
  Description of Artificial Sequence: Synthetic peptide
  XENP021065 vlCDR2
AASNLES

SEQ ID NO: 30453 - protein, 9 aa, Artificial Sequence
  Description of Artificial Sequence: Synthetic peptide
  XENP021065 vlCDR3
QQSNEDPFT

SEQ ID NO: 30454 - protein, 226 aa, Artificial Sequence
  Description of Artificial Sequence: Synthetic polypeptide
  XENP021066 7G8_H0.141_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30455 - protein, 121 aa, Artificial Sequence; identical to SEQ ID NO: 19616
  Description of Artificial Sequence: Synthetic polypeptide
  VH of XENP021066

SEQ ID NO: 30456 - protein, 5 aa, Artificial Sequence
  Description of Artificial Sequence: Synthetic peptide
  XENP021066 vhCDR1
DAWMD

SEQ ID NO: 30457 - protein, 19 aa, Artificial Sequence
  Description of Artificial Sequence: Synthetic peptide
  XENP021066 vhCDR2
EIRTKANNHATYYAESVKG

SEQ ID NO: 30458 - protein, 10 aa, Artificial Sequence
  Description of Artificial Sequence: Synthetic peptide
  XENP021066 vhCDR3
LANWNWYFDV

SEQ ID NO: 30459 - protein, 218 aa, Artificial Sequence; identical to SEQ ID NO: 17590
  Description of Artificial Sequence: Synthetic polypeptide
  XENP021066 7G8_H0.141_L0_Fab Light Chain

SEQ ID NO: 30460 - protein, 111 aa, Artificial Sequence; identical to SEQ ID NO: 17591
  Description of Artificial Sequence: Synthetic polypeptide
  VL of XENP021066

SEQ ID NO: 30461 - protein, 15 aa, Artificial Sequence
  Description of Artificial Sequence: Synthetic peptide
  XENP021066 vlCDR1
KASQSVDYDGDSYMN

SEQ ID NO: 30462 - protein, 7 aa, Artificial Sequence
  Description of Artificial Sequence: Synthetic peptide
  XENP021066 vlCDR2
AASNLES

SEQ ID NO: 30463 - protein, 9 aa, Artificial Sequence
  Description of Artificial Sequence: Synthetic peptide
  XENP021066 vlCDR3
QQSNEDPFT

SEQ ID NO: 30464 - protein, 226 aa, Artificial Sequence
  Description of Artificial Sequence: Synthetic polypeptide
  XENP021067 7G8_H0.142_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30465 - protein, 121 aa, Artificial Sequence; identical to SEQ ID NO: 19626
  Description of Artificial Sequence: Synthetic polypeptide
  VH of XENP021067

SEQ ID NO: 30466 - protein, 5 aa, Artificial Sequence
  Description of Artificial Sequence: Synthetic peptide
  XENP021067 vhCDR1
DAWMD

SEQ ID NO: 30467 - protein, 19 aa, Artificial Sequence
  Description of Artificial Sequence: Synthetic peptide
  XENP021067 vhCDR2
EIRTKANNHATYYAESVKG

SEQ ID NO: 30468 - protein, 10 aa, Artificial Sequence
  Description of Artificial Sequence: Synthetic peptide
  XENP021067 vhCDR3
LANWEWYFDV

SEQ ID NO: 30469 - protein, 218 aa, Artificial Sequence; identical to SEQ ID NO: 17590
  Description of Artificial Sequence: Synthetic polypeptide
  XENP021067 7G8_H0.142_L0_Fab Light Chain

SEQ ID NO: 30470 - protein, 111 aa, Artificial Sequence; identical to SEQ ID NO: 17591
  Description of Artificial Sequence: Synthetic polypeptide
  VL of XENP021067

SEQ ID NO: 30471 - protein, 15 aa, Artificial Sequence
  Description of Artificial Sequence: Synthetic peptide
  XENP021067 vlCDR1
KASQSVDYDGDSYMN

SEQ ID NO: 30472 - protein, 7 aa, Artificial Sequence
  Description of Artificial Sequence: Synthetic peptide
  XENP021067 vlCDR2
AASNLES

SEQ ID NO: 30473 - protein, 9 aa, Artificial Sequence
  Description of Artificial Sequence: Synthetic peptide
  XENP021067 vlCDR3
QQSNEDPFT

SEQ ID NO: 30474 - protein, 226 aa, Artificial Sequence
  Description of Artificial Sequence: Synthetic polypeptide
  XENP021068 7G8_H0.143_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30475 - protein, 121 aa, Artificial Sequence; identical to SEQ ID NO: 19636
  Description of Artificial Sequence: Synthetic polypeptide
  VH of XENP021068

SEQ ID NO: 30476 - protein, 5 aa, Artificial Sequence
  Description of Artificial Sequence: Synthetic peptide
  XENP021068 vhCDR1
DAWMD

SEQ ID NO: 30477 - protein, 19 aa, Artificial Sequence
  Description of Artificial Sequence: Synthetic peptide
  XENP021068 vhCDR2
EIRTKANNHATYYAESVKG

SEQ ID NO: 30478 - protein, 10 aa, Artificial Sequence
  Description of Artificial Sequence: Synthetic peptide
  XENP021068 vhCDR3
LANWHWYFDV

SEQ ID NO: 30479 - protein, 218 aa, Artificial Sequence; identical to SEQ ID NO: 17590
  Description of Artificial Sequence: Synthetic polypeptide
  XENP021068 7G8_H0.143_L0_Fab Light Chain

SEQ ID NO: 30480 - protein, 111 aa, Artificial Sequence; identical to SEQ ID NO: 17591
  Description of Artificial Sequence: Synthetic polypeptide
  VL of XENP021068

SEQ ID NO: 30481 - protein, 15 aa, Artificial Sequence
  Description of Artificial Sequence: Synthetic peptide
  XENP021068 vlCDR1
KASQSVDYDGDSYMN

SEQ ID NO: 30482 - protein, 7 aa, Artificial Sequence
  Description of Artificial Sequence: Synthetic peptide
  XENP021068 vlCDR2
AASNLES

SEQ ID NO: 30483 - protein, 9 aa, Artificial Sequence
  Description of Artificial Sequence: Synthetic peptide
  XENP021068 vlCDR3
QQSNEDPFT

SEQ ID NO: 30484 - protein, 226 aa, Artificial Sequence
  Description of Artificial Sequence: Synthetic polypeptide
  XENP021069 7G8_H0.145_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30485 - protein, 121 aa, Artificial Sequence; identical to SEQ ID NO: 19656
  Description of Artificial Sequence: Synthetic polypeptide
  VH of XENP021069

SEQ ID NO: 30486 - protein, 5 aa, Artificial Sequence
  Description of Artificial Sequence: Synthetic peptide
  XENP021069 vhCDR1
DAWMD

SEQ ID NO: 30487 - protein, 19 aa, Artificial Sequence
  Description of Artificial Sequence: Synthetic peptide
  XENP021069 vhCDR2
EIRTKANNHATYYAESVKG

SEQ ID NO: 30488 - protein, 10 aa, Artificial Sequence
  Description of Artificial Sequence: Synthetic peptide
  XENP021069 vhCDR3
LANWLWYFDV

SEQ ID NO: 30489 - protein, 218 aa, Artificial Sequence; identical to SEQ ID NO: 17590
  Description of Artificial Sequence: Synthetic polypeptide
  XENP021069 7G8_H0.145_L0_Fab Light Chain

SEQ ID NO: 30490 - protein, 111 aa, Artificial Sequence; identical to SEQ ID NO: 17591
  Description of Artificial Sequence: Synthetic polypeptide
  VL of XENP021069

SEQ ID NO: 30491 - protein, 15 aa, Artificial Sequence
  Description of Artificial Sequence: Synthetic peptide
  XENP021069 vlCDR1
KASQSVDYDGDSYMN

SEQ ID NO: 30492 - protein, 7 aa, Artificial Sequence
  Description of Artificial Sequence: Synthetic peptide
  XENP021069 vlCDR2
AASNLES

SEQ ID NO: 30493 - protein, 9 aa, Artificial Sequence
  Description of Artificial Sequence: Synthetic peptide
  XENP021069 vlCDR3
QQSNEDPFT

SEQ ID NO: 30494 - protein, 226 aa, Artificial Sequence
  Description of Artificial Sequence: Synthetic polypeptide
  XENP021070 7G8_H0.146_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30495 - protein, 121 aa, Artificial Sequence; identical to SEQ ID NO: 19666
  Description of Artificial Sequence: Synthetic polypeptide
  VH of XENP021070

SEQ ID NO: 30496 - protein, 5 aa, Artificial Sequence
  Description of Artificial Sequence: Synthetic peptide
  XENP021070 vhCDR1
DAWMD

SEQ ID NO: 30497 - protein, 19 aa, Artificial Sequence
  Description of Artificial Sequence: Synthetic peptide
  XENP021070 vhCDR2
EIRTKANNHATYYAESVKG

SEQ ID NO: 30498 - protein, 10 aa, Artificial Sequence
  Description of Artificial Sequence: Synthetic peptide
  XENP021070 vhCDR3
LANWGWYFDV

SEQ ID NO: 30499 - protein, 218 aa, Artificial Sequence; identical to SEQ ID NO: 17590
  Description of Artificial Sequence: Synthetic polypeptide
  XENP021070 7G8_H0.146_L0_Fab Light Chain

SEQ ID NO: 30500 - protein, 111 aa, Artificial Sequence; identical to SEQ ID NO: 17591
  Description of Artificial Sequence: Synthetic polypeptide
  VL of XENP021070

SEQ ID NO: 30501 - protein, 15 aa, Artificial Sequence
  Description of Artificial Sequence: Synthetic peptide
  XENP021070 vlCDR1
KASQSVDYDGDSYMN

SEQ ID NO: 30502 - protein, 7 aa, Artificial Sequence
  Description of Artificial Sequence: Synthetic peptide
  XENP021070 vlCDR2
AASNLES

SEQ ID NO: 30503 - protein, 9 aa, Artificial Sequence
  Description of Artificial Sequence: Synthetic peptide
  XENP021070 vlCDR3
QQSNEDPFT

SEQ ID NO: 30504 - protein, 226 aa, Artificial Sequence
  Description of Artificial Sequence: Synthetic polypeptide
  XENP021071 7G8_H0.147_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30505 - protein, 121 aa, Artificial Sequence; identical to SEQ ID NO: 19676
  Description of Artificial Sequence: Synthetic polypeptide
  VH of XENP021071

SEQ ID NO: 30506 - protein, 5 aa, Artificial Sequence
  Description of Artificial Sequence: Synthetic peptide
  XENP021071 vhCDR1
DAWMD

SEQ ID NO: 30507 - protein, 19 aa, Artificial Sequence
  Description of Artificial Sequence: Synthetic peptide
  XENP021071 vhCDR2
EIRTKANNHATYYAESVKG

SEQ ID NO: 30508 - protein, 10 aa, Artificial Sequence
  Description of Artificial Sequence: Synthetic peptide
  XENP021071 vhCDR3
LANWYWYFDV

SEQ ID NO: 30509 - protein, 218 aa, Artificial Sequence; identical to SEQ ID NO: 17590
  Description of Artificial Sequence: Synthetic polypeptide
  XENP021071 7G8_H0.147_L0_Fab Light Chain

SEQ ID NO: 30510 - protein, 111 aa, Artificial Sequence; identical to SEQ ID NO: 17591
  Description of Artificial Sequence: Synthetic polypeptide
  VL of XENP021071

SEQ ID NO: 30511 - protein, 15 aa, Artificial Sequence
  Description of Artificial Sequence: Synthetic peptide
  XENP021071 vlCDR1
KASQSVDYDGDSYMN

SEQ ID NO: 30512 - protein, 7 aa, Artificial Sequence
  Description of Artificial Sequence: Synthetic peptide
  XENP021071 vlCDR2
AASNLES

SEQ ID NO: 30513 - protein, 9 aa, Artificial Sequence
  Description of Artificial Sequence: Synthetic peptide
  XENP021071 vlCDR3
QQSNEDPFT

SEQ ID NO: 30514 - protein, 226 aa, Artificial Sequence
  Description of Artificial Sequence: Synthetic polypeptide
  XENP021072 7G8_H0.148_L0_Fab Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 30515 - protein, 121 aa, Artificial Sequence; identical to SEQ ID NO: 19686
  Description of Artificial Sequence: Synthetic polypeptide
  VH of XENP021072

SEQ ID NO: 30516 - protein, 5 aa, Artificial Sequence
  Description of Artificial Sequence: Synthetic peptide
  XENP021072 vhCDR1
DAWMD

SEQ ID NO: 30517 - protein, 19 aa, Artificial Sequence
  Description of Artificial Sequence: Synthetic peptide
  XENP021072 vhCDR2
EIRTKANNHATYYAESVKG

SEQ ID NO: 30518 - protein, 10 aa, Artificial Sequence
  Description of Artificial Sequence: Synthetic peptide
  XENP021072 vhCDR3
LANWDYYFDV

SEQ ID NO: 30519 - protein, 218 aa, Artificial Sequence; identical to SEQ ID NO: 17590
  Description of Artificial Sequence: Synthetic polypeptide
  XENP021072 7G8_H0.148_L0_Fab Light Chain

SEQ ID NO: 30520 - protein, 111 aa, Artificial Sequence; identical to SEQ ID NO: 17591
  Description of Artificial Sequence: Synthetic polypeptide
  VL of XENP021072

SEQ ID NO: 30521 - protein, 15 aa, Artificial Sequence
  Description of Artificial Sequence: Synthetic peptide
  XENP021072 vlCDR1
KASQSVDYDGDSYMN

SEQ ID NO: 30522 - protein, 7 aa, Artificial Sequence
  Description of Artificial Sequence: Synthetic peptide
  XENP021072 vlCDR2
AASNLES

SEQ ID NO: 30523 - protein, 9 aa, Artificial Sequence
  Description of Artificial Sequence: Synthetic peptide
  XENP021072 vlCDR3
QQSNEDPFT

SEQ ID NO: 30524 - protein, 226 aa, Artificial Sequence; identical to SEQ ID NO: 29134
  Description of Artificial Sequence: Synthetic polypeptide
  XENP021074 7G8_H0_L0.1_Fab Heavy Chain

SEQ ID NO: 30525 - protein, 121 aa, Artificial Sequence; identical to SEQ ID NO: 17586
  Description of Artificial Sequence: Synthetic polypeptide
  VH of XENP021074

SEQ ID NO: 30526 - protein, 5 aa, Artificial Sequence
  Description of Artificial Sequence: Synthetic peptide
  XENP021074 vhCDR1
DAWMD

SEQ ID NO: 30527 - protein, 19 aa, Artificial Sequence
  Description of Artificial Sequence: Synthetic peptide
  XENP021074 vhCDR2
EIRTKANNHATYYAESVKG

SEQ ID NO: 30528 - protein, 10 aa, Artificial Sequence
  Description of Artificial Sequence: Synthetic peptide
  XENP021074 vhCDR3
LANWDWYFDV

SEQ ID NO: 30529 - protein, 218 aa, Artificial Sequence; identical to SEQ ID NO: 19700
  Description of Artificial Sequence: Synthetic polypeptide
  XENP021074 7G8_H0_L0.1_Fab Light Chain

SEQ ID NO: 30530 - protein, 111 aa, Artificial Sequence; identical to SEQ ID NO: 19701
  Description of Artificial Sequence: Synthetic polypeptide
  VL of XENP021074

SEQ ID NO: 30531 - protein, 15 aa, Artificial Sequence
  Description of Artificial Sequence: Synthetic peptide
  XENP021074 vlCDR1
KASQSVNYDGDSYMN

SEQ ID NO: 30532 - protein, 7 aa, Artificial Sequence
  Description of Artificial Sequence: Synthetic peptide
  XENP021074 vlCDR2
AASNLES

SEQ ID NO: 30533 - protein, 9 aa, Artificial Sequence
  Description of Artificial Sequence: Synthetic peptide
  XENP021074 vlCDR3
QQSNEDPFT

SEQ ID NO: 30534 - protein, 226 aa, Artificial Sequence; identical to SEQ ID NO: 29134
  Description of Artificial Sequence: Synthetic polypeptide
  XENP021075 7G8_H0_L0.2_Fab Heavy Chain

SEQ ID NO: 30535 - protein, 121 aa, Artificial Sequence; identical to SEQ ID NO: 17586
  Description of Artificial Sequence: Synthetic polypeptide
  VH of XENP021075

SEQ ID NO: 30536 - protein, 5 aa, Artificial Sequence
  Description of Artificial Sequence: Synthetic peptide
  XENP021075 vhCDR1
DAWMD

SEQ ID NO: 30537 - protein, 19 aa, Artificial Sequence
  Description of Artificial Sequence: Synthetic peptide
  XENP021075 vhCDR2
EIRTKANNHATYYAESVKG

SEQ ID NO: 30538 - protein, 10 aa, Artificial Sequence
  Description of Artificial Sequence: Synthetic peptide
  XENP021075 vhCDR3
LANWDWYFDV

SEQ ID NO: 30539 - protein, 218 aa, Artificial Sequence; identical to SEQ ID NO: 19710
  Description of Artificial Sequence: Synthetic polypeptide
  XENP021075 7G8_H0_L0.2_Fab Light Chain

SEQ ID NO: 30540 - protein, 111 aa, Artificial Sequence; identical to SEQ ID NO: 19711
  Description of Artificial Sequence: Synthetic polypeptide
  VL of XENP021075

SEQ ID NO: 30541 - protein, 15 aa, Artificial Sequence
  Description of Artificial Sequence: Synthetic peptide
  XENP021075 vlCDR1
KASQSVEYDGDSYMN

SEQ ID NO: 30542 - protein, 7 aa, Artificial Sequence
  Description of Artificial Sequence: Synthetic peptide
  XENP021075 vlCDR2
AASNLES

SEQ ID NO: 30543 - protein, 9 aa, Artificial Sequence
  Description of Artificial Sequence: Synthetic peptide
  XENP021075 vlCDR3
QQSNEDPFT

SEQ ID NO: 30544 - protein, 226 aa, Artificial Sequence; identical to SEQ ID NO: 29134
  Description of Artificial Sequence: Synthetic polypeptide
  XENP021076 7G8_H0_L0.3_Fab Heavy Chain

SEQ ID NO: 30545 - protein, 121 aa, Artificial Sequence; identical to SEQ ID NO: 17586
  Description of Artificial Sequence: Synthetic polypeptide
  VH of XENP021076

SEQ ID NO: 30546 - protein, 5 aa, Artificial Sequence
  Description of Artificial Sequence: Synthetic peptide
  XENP021076 vhCDR1
DAWMD

SEQ ID NO: 30547 - protein, 19 aa, Artificial Sequence
  Description of Artificial Sequence: Synthetic peptide
  XENP021076 vhCDR2
EIRTKANNHATYYAESVKG

SEQ ID NO: 30548 - protein, 10 aa, Artificial Sequence
  Description of Artificial Sequence: Synthetic peptide
  XENP021076 vhCDR3
LANWDWYFDV

SEQ ID NO: 30549 - protein, 218 aa, Artificial Sequence; identical to SEQ ID NO: 19720
  Description of Artificial Sequence: Synthetic polypeptide
  XENP021076 7G8_H0_L0.3_Fab Light Chain

SEQ ID NO: 30550 - protein, 111 aa, Artificial Sequence; identical to SEQ ID NO: 19721
  Description of Artificial Sequence: Synthetic polypeptide
  VL of XENP021076

SEQ ID NO: 30551 - protein, 15 aa, Artificial Sequence
  Description of Artificial Sequence: Synthetic peptide
  XENP021076 vlCDR1
KASQSVHYDGDSYMN

SEQ ID NO: 30552 - protein, 7 aa, Artificial Sequence
  Description of Artificial Sequence: Synthetic peptide
  XENP021076 vlCDR2
AASNLES

SEQ ID NO: 30553 - protein, 9 aa, Artificial Sequence
  Description of Artificial Sequence: Synthetic peptide
  XENP021076 vlCDR3
QQSNEDPFT

SEQ ID NO: 30554 - protein, 226 aa, Artificial Sequence; identical to SEQ ID NO: 29134
  Description of Artificial Sequence: Synthetic polypeptide
  XENP021077 7G8_H0_L0.4_Fab Heavy Chain

SEQ ID NO: 30555 - protein, 121 aa, Artificial Sequence; identical to SEQ ID NO: 17586
  Description of Artificial Sequence: Synthetic polypeptide
  VH of XENP021077

SEQ ID NO: 30556 - protein, 5 aa, Artificial Sequence
  Description of Artificial Sequence: Synthetic peptide
  XENP021077 vhCDR1
DAWMD

SEQ ID NO: 30557 - protein, 19 aa, Artificial Sequence
  Description of Artificial Sequence: Synthetic peptide
  XENP021077 vhCDR2
EIRTKANNHATYYAESVKG

SEQ ID NO: 30558 - protein, 10 aa, Artificial Sequence
  Description of Artificial Sequence: Synthetic peptide
  XENP021077 vhCDR3
LANWDWYFDV

SEQ ID NO: 30559 - protein, 218 aa, Artificial Sequence; identical to SEQ ID NO: 19730
  Description of Artificial Sequence: Synthetic polypeptide
  XENP021077 7G8_H0_L0.4_Fab Light Chain

SEQ ID NO: 30560 - protein, 111 aa, Artificial Sequence; identical to SEQ ID NO: 19731
  Description of Artificial Sequence: Synthetic polypeptide
  VL of XENP021077

SEQ ID NO: 30561 - protein, 15 aa, Artificial Sequence
  Description of Artificial Sequence: Synthetic peptide
  XENP021077 vlCDR1
KASQSVSYDGDSYMN

SEQ ID NO: 30562 - protein, 7 aa, Artificial Sequence
  Description of Artificial Sequence: Synthetic peptide
  XENP021077 vlCDR2
AASNLES

SEQ ID NO: 30563 - protein, 9 aa, Artificial Sequence
  Description of Artificial Sequence: Synthetic peptide
  XENP021077 vlCDR3
QQSNEDPFT

SEQ ID NO: 30564 - protein, 226 aa, Artificial Sequence; identical to SEQ ID NO: 29134
  Description of Artificial Sequence: Synthetic polypeptide
  XENP021078 7G8_H0_L0.5_Fab Heavy Chain

SEQ ID NO: 30565 - protein, 121 aa, Artificial Sequence; identical to SEQ ID NO: 17586
  Description of Artificial Sequence: Synthetic polypeptide
  VH of XENP021078

SEQ ID NO: 30566 - protein, 5 aa, Artificial Sequence
  Description of Artificial Sequence: Synthetic peptide
  XENP021078 vhCDR1
DAWMD

SEQ ID NO: 30567 - protein, 19 aa, Artificial Sequence
  Description of Artificial Sequence: Synthetic peptide
  XENP021078 vhCDR2
EIRTKANNHATYYAESVKG

SEQ ID NO: 30568 - protein, 10 aa, Artificial Sequence
  Description of Artificial Sequence: Synthetic peptide
  XENP021078 vhCDR3
LANWDWYFDV

SEQ ID NO: 30569 - protein, 218 aa, Artificial Sequence; identical to SEQ ID NO: 19740
  Description of Artificial Sequence: Synthetic polypeptide
  XENP021078 7G8_H0_L0.5_Fab Light Chain

SEQ ID NO: 30570 - protein, 111 aa, Artificial Sequence; identical to SEQ ID NO: 19741
  Description of Artificial Sequence: Synthetic polypeptide
  VL of XENP021078

SEQ ID NO: 30571 - protein, 15 aa, Artificial Sequence
  Description of Artificial Sequence: Synthetic peptide
  XENP021078 vlCDR1
KASQSVRYDGDSYMN

SEQ ID NO: 30572 - protein, 7 aa, Artificial Sequence
  Description of Artificial Sequence: Synthetic peptide
  XENP021078 vlCDR2
AASNLES

SEQ ID NO: 30573 - protein, 9 aa, Artificial Sequence
  Description of Artificial Sequence: Synthetic peptide
  XENP021078 vlCDR3
QQSNEDPFT

SEQ ID NO: 30574 - protein, 226 aa, Artificial Sequence; identical to SEQ ID NO: 29134
  Description of Artificial Sequence: Synthetic polypeptide
  XENP021079 7G8_H0_L0.6_Fab Heavy Chain

SEQ ID NO: 30575 - protein, 121 aa, Artificial Sequence; identical to SEQ ID NO: 17586
  Description of Artificial Sequence: Synthetic polypeptide
  VH of XENP021079

SEQ ID NO: 30576 - protein, 5 aa, Artificial Sequence
  Description of Artificial Sequence: Synthetic peptide
  XENP021079 vhCDR1
DAWMD

SEQ ID NO: 30577 - protein, 19 aa, Artificial Sequence
  Description of Artificial Sequence: Synthetic peptide
  XENP021079 vhCDR2
EIRTKANNHATYYAESVKG

SEQ ID NO: 30578 - protein, 10 aa, Artificial Sequence
  Description of Artificial Sequence: Synthetic peptide
  XENP021079 vhCDR3
LANWDWYFDV

SEQ ID NO: 30579 - protein, 218 aa, Artificial Sequence; identical to SEQ ID NO: 19750
  Description of Artificial Sequence: Synthetic polypeptide
  XENP021079 7G8_H0_L0.6_Fab Light Chain

SEQ ID NO: 30580 - protein, 111 aa, Artificial Sequence; identical to SEQ ID NO: 19751
  Description of Artificial Sequence: Synthetic polypeptide
  VL of XENP021079

SEQ ID NO: 30581 - protein, 15 aa, Artificial Sequence
  Description of Artificial Sequence: Synthetic peptide
  XENP021079 vlCDR1
KASQSVLYDGDSYMN

SEQ ID NO: 30582 - protein, 7 aa, Artificial Sequence
  Description of Artificial Sequence: Synthetic peptide
  XENP021079 vlCDR2
AASNLES

SEQ ID NO: 30583 - protein, 9 aa, Artificial Sequence
  Description of Artificial Sequence: Synthetic peptide
  XENP021079 vlCDR3
QQSNEDPFT

SEQ ID NO: 30584 - protein, 226 aa, Artificial Sequence; identical to SEQ ID NO: 29134
  Description of Artificial Sequence: Synthetic polypeptide
  XENP021080 7G8_H0_L0.7_Fab Heavy Chain

SEQ ID NO: 30585 - protein, 121 aa, Artificial Sequence; identical to SEQ ID NO: 17586
  Description of Artificial Sequence: Synthetic polypeptide
  VH of XENP021080

SEQ ID NO: 30586 - protein, 5 aa, Artificial Sequence
  Description of Artificial Sequence: Synthetic peptide
  XENP021080 vhCDR1
DAWMD

SEQ ID NO: 30587 - protein, 19 aa, Artificial Sequence
  Description of Artificial Sequence: Synthetic peptide
  XENP021080 vhCDR2
EIRTKANNHATYYAESVKG

SEQ ID NO: 30588 - protein, 10 aa, Artificial Sequence
  Description of Artificial Sequence: Synthetic peptide
  XENP021080 vhCDR3
LANWDWYFDV

SEQ ID NO: 30589 - protein, 218 aa, Artificial Sequence; identical to SEQ ID NO: 19760
  Description of Artificial Sequence: Synthetic polypeptide
  XENP021080 7G8_H0_L0.7_Fab Light Chain

SEQ ID NO: 30590 - protein, 111 aa, Artificial Sequence; identical to SEQ ID NO: 19761
  Description of Artificial Sequence: Synthetic polypeptide
  VL of XENP021080

SEQ ID NO: 30591 - protein, 15 aa, Artificial Sequence
  Description of Artificial Sequence: Synthetic peptide
  XENP021080 vlCDR1
KASQSVTYDGDSYMN

SEQ ID NO: 30592 - protein, 7 aa, Artificial Sequence
  Description of Artificial Sequence: Synthetic peptide
  XENP021080 vlCDR2
AASNLES

SEQ ID NO: 30593 - protein, 9 aa, Artificial Sequence
  Description of Artificial Sequence: Synthetic peptide
  XENP021080 vlCDR3
QQSNEDPFT

SEQ ID NO: 30594 - protein, 226 aa, Artificial Sequence; identical to SEQ ID NO: 29134
  Description of Artificial Sequence: Synthetic polypeptide
  XENP021081 7G8_H0_L0.8_Fab Heavy Chain

SEQ ID NO: 30595 - protein, 121 aa, Artificial Sequence; identical to SEQ ID NO: 17586
  Description of Artificial Sequence: Synthetic polypeptide
  VH of XENP021081

SEQ ID NO: 30596 - protein, 5 aa, Artificial Sequence
  Description of Artificial Sequence: Synthetic peptide
  XENP021081 vhCDR1
DAWMD

SEQ ID NO: 30597 - protein, 19 aa, Artificial Sequence
  Description of Artificial Sequence: Synthetic peptide
  XENP021081 vhCDR2
EIRTKANNHATYYAESVKG

SEQ ID NO: 30598 - protein, 10 aa, Artificial Sequence
  Description of Artificial Sequence: Synthetic peptide
  XENP021081 vhCDR3
LANWDWYFDV

SEQ ID NO: 30599 - protein, 218 aa, Artificial Sequence; identical to SEQ ID NO: 19770
  Description of Artificial Sequence: Synthetic polypeptide
  XENP021081 7G8_H0_L0.8_Fab Light Chain

SEQ ID NO: 30600 - protein, 111 aa, Artificial Sequence; identical to SEQ ID NO: 19771
  Description of Artificial Sequence: Synthetic polypeptide
  VL of XENP021081

SEQ ID NO: 30601 - protein, 15 aa, Artificial Sequence
  Description of Artificial Sequence: Synthetic peptide
  XENP021081 vlCDR1
KASQSVGYDGDSYMN

SEQ ID NO: 30602 - protein, 7 aa, Artificial Sequence
  Description of Artificial Sequence: Synthetic peptide
  XENP021081 vlCDR2
AASNLES

SEQ ID NO: 30603 - protein, 9 aa, Artificial Sequence
  Description of Artificial Sequence: Synthetic peptide
  XENP021081 vlCDR3
QQSNEDPFT

SEQ ID NO: 30604 - protein, 226 aa, Artificial Sequence; identical to SEQ ID NO: 29134
  Description of Artificial Sequence: Synthetic polypeptide
  XENP021082 7G8_H0_L0.9_Fab Heavy Chain

SEQ ID NO: 30605 - protein, 121 aa, Artificial Sequence; identical to SEQ ID NO: 17586
  Description of Artificial Sequence: Synthetic polypeptide
  VH of XENP021082

SEQ ID NO: 30606 - protein, 5 aa, Artificial Sequence
  Description of Artificial Sequence: Synthetic peptide
  XENP021082 vhCDR1
DAWMD

SEQ ID NO: 30607 - protein, 19 aa, Artificial Sequence
  Description of Artificial Sequence: Synthetic peptide
  XENP021082 vhCDR2
EIRTKANNHATYYAESVKG

SEQ ID NO: 30608 - protein, 10 aa, Artificial Sequence
  Description of Artificial Sequence: Synthetic peptide
  XENP021082 vhCDR3
LANWDWYFDV

SEQ ID NO: 30609 - protein, 218 aa, Artificial Sequence; identical to SEQ ID NO: 19780
  Description of Artificial Sequence: Synthetic polypeptide
  XENP021082 7G8_H0_L0.9_Fab Light Chain

SEQ ID NO: 30610 - protein, 111 aa, Artificial Sequence; identical to SEQ ID NO: 19781
  Description of Artificial Sequence: Synthetic polypeptide
  VL of XENP021082

SEQ ID NO: 30611 - protein, 15 aa, Artificial Sequence
  Description of Artificial Sequence: Synthetic peptide
  XENP021082 vlCDR1
KASQSVYYDGDSYMN

SEQ ID NO: 30612 - protein, 7 aa, Artificial Sequence
  Description of Artificial Sequence: Synthetic peptide
  XENP021082 vlCDR2
AASNLES

SEQ ID NO: 30613 - protein, 9 aa, Artificial Sequence
  Description of Artificial Sequence: Synthetic peptide
  XENP021082 vlCDR3
QQSNEDPFT

SEQ ID NO: 30614 - protein, 226 aa, Artificial Sequence; identical to SEQ ID NO: 29134
  Description of Artificial Sequence: Synthetic polypeptide
  XENP021083 7G8_H0_L0.10_Fab Heavy Chain

SEQ ID NO: 30615 - protein, 121 aa, Artificial Sequence; identical to SEQ ID NO: 17586
  Description of Artificial Sequence: Synthetic polypeptide
  VH of XENP021083

SEQ ID NO: 30616 - protein, 5 aa, Artificial Sequence
  Description of Artificial Sequence: Synthetic peptide
  XENP021083 vhCDR1
DAWMD

SEQ ID NO: 30617 - protein, 19 aa, Artificial Sequence
  Description of Artificial Sequence: Synthetic peptide
  XENP021083 vhCDR2
EIRTKANNHATYYAESVKG

SEQ ID NO: 30618 - protein, 10 aa, Artificial Sequence
  Description of Artificial Sequence: Synthetic peptide
  XENP021083 vhCDR3
LANWDWYFDV

SEQ ID NO: 30619 - protein, 218 aa, Artificial Sequence; identical to SEQ ID NO: 19790
  Description of Artificial Sequence: Synthetic polypeptide
  XENP021083 7G8_H0_L0.10_Fab Light Chain

SEQ ID NO: 30620 - protein, 111 aa, Artificial Sequence; identical to SEQ ID NO: 19791
  Description of Artificial Sequence: Synthetic polypeptide
  VL of XENP021083

SEQ ID NO: 30621 - protein, 15 aa, Artificial Sequence
  Description of Artificial Sequence: Synthetic peptide
  XENP021083 vlCDR1
KASQSVDFDGDSYMN

SEQ ID NO: 30622 - protein, 7 aa, Artificial Sequence
  Description of Artificial Sequence: Synthetic peptide
  XENP021083 vlCDR2
AASNLES

SEQ ID NO: 30623 - protein, 9 aa, Artificial Sequence
  Description of Artificial Sequence: Synthetic peptide
  XENP021083 vlCDR3
QQSNEDPFT

SEQ ID NO: 30624 - protein, 226 aa, Artificial Sequence; identical to SEQ ID NO: 29134
  Description of Artificial Sequence: Synthetic polypeptide
  XENP021084 7G8_H0_L0.11_Fab Heavy Chain

SEQ ID NO: 30625 - protein, 121 aa, Artificial Sequence; identical to SEQ ID NO: 17586
  Description of Artificial Sequence: Synthetic polypeptide
  VH of XENP021084

SEQ ID NO: 30626 - protein, 5 aa, Artificial Sequence
  Description of Artificial Sequence: Synthetic peptide
  XENP021084 vhCDR1
DAWMD

SEQ ID NO: 30627 - protein, 19 aa, Artificial Sequence
  Description of Artificial Sequence: Synthetic peptide
  XENP021084 vhCDR2
EIRTKANNHATYYAESVKG

SEQ ID NO: 30628 - protein, 10 aa, Artificial Sequence
  Description of Artificial Sequence: Synthetic peptide
  XENP021084 vhCDR3
LANWDWYFDV

SEQ ID NO: 30629 - protein, 218 aa, Artificial Sequence; identical to SEQ ID NO: 19800
  Description of Artificial Sequence: Synthetic polypeptide
  XENP021084 7G8_H0_L0.11_Fab Light Chain

SEQ ID NO: 30630 - protein, 111 aa, Artificial Sequence; identical to SEQ ID NO: 19801
  Description of Artificial Sequence: Synthetic polypeptide
  VL of XENP021084

SEQ ID NO: 30631 - protein, 15 aa, Artificial Sequence
  Description of Artificial Sequence: Synthetic peptide
  XENP021084 vlCDR1
KASQSVDHDGDSYMN

SEQ ID NO: 30632 - protein, 7 aa, Artificial Sequence
  Description of Artificial Sequence: Synthetic peptide
  XENP021084 vlCDR2
AASNLES

SEQ ID NO: 30633 - protein, 9 aa, Artificial Sequence
  Description of Artificial Sequence: Synthetic peptide
  XENP021084 vlCDR3
QQSNEDPFT

SEQ ID NO: 30634 - protein, 226 aa, Artificial Sequence; identical to SEQ ID NO: 29134
  Description of Artificial Sequence: Synthetic polypeptide
  XENP021085 7G8_H0_L0.12_Fab Heavy Chain

SEQ ID NO: 30635 - protein, 121 aa, Artificial Sequence; identical to SEQ ID NO: 17586
  Description of Artificial Sequence: Synthetic polypeptide
  VH of XENP021085

SEQ ID NO: 30636 - protein, 5 aa, Artificial Sequence
  Description of Artificial Sequence: Synthetic peptide
  XENP021085 vhCDR1
DAWMD

SEQ ID NO: 30637 - protein, 19 aa, Artificial Sequence
  Description of Artificial Sequence: Synthetic peptide
  XENP021085 vhCDR2
EIRTKANNHATYYAESVKG

SEQ ID NO: 30638 - protein, 10 aa, Artificial Sequence
  Description of Artificial Sequence: Synthetic peptide
  XENP021085 vhCDR3
LANWDWYFDV

SEQ ID NO: 30639 - protein, 218 aa, Artificial Sequence; identical to SEQ ID NO: 19810
  Description of Artificial Sequence: Synthetic polypeptide
  XENP021085 7G8_H0_L0.12_Fab Light Chain

SEQ ID NO: 30640 - protein, 111 aa, Artificial Sequence; identical to SEQ ID NO: 19811
  Description of Artificial Sequence: Synthetic polypeptide
  VL of XENP021085

SEQ ID NO: 30641 - protein, 15 aa, Artificial Sequence
  Description of Artificial Sequence: Synthetic peptide
  XENP021085 vlCDR1
KASQSVDLDGDSYMN

SEQ ID NO: 30642 - protein, 7 aa, Artificial Sequence
  Description of Artificial Sequence: Synthetic peptide
  XENP021085 vlCDR2
AASNLES

SEQ ID NO: 30643 - protein, 9 aa, Artificial Sequence
  Description of Artificial Sequence: Synthetic peptide
  XENP021085 vlCDR3
QQSNEDPFT

SEQ ID NO: 30644 - protein, 226 aa, Artificial Sequence; identical to SEQ ID NO: 29134
  Description of Artificial Sequence: Synthetic polypeptide
  XENP021086 7G8_H0_L0.13_Fab Heavy Chain

SEQ ID NO: 30645 - protein, 121 aa, Artificial Sequence; identical to SEQ ID NO: 17586
  Description of Artificial Sequence: Synthetic polypeptide
  VH of XENP021086

SEQ ID NO: 30646 - protein, 5 aa, Artificial Sequence
  Description of Artificial Sequence: Synthetic peptide
  XENP021086 vhCDR1
DAWMD

SEQ ID NO: 30647 - protein, 19 aa, Artificial Sequence
  Description of Artificial Sequence: Synthetic peptide
  XENP021086 vhCDR2
EIRTKANNHATYYAESVKG

SEQ ID NO: 30648 - protein, 10 aa, Artificial Sequence
  Description of Artificial Sequence: Synthetic peptide
  XENP021086 vhCDR3
LANWDWYFDV

SEQ ID NO: 30649 - protein, 218 aa, Artificial Sequence; identical to SEQ ID NO: 19820
  Description of Artificial Sequence: Synthetic polypeptide
  XENP021086 7G8_H0_L0.13_Fab Light Chain

SEQ ID NO: 30650 - protein, 111 aa, Artificial Sequence; identical to SEQ ID NO: 19821
  Description of Artificial Sequence: Synthetic polypeptide
  VL of XENP021086

SEQ ID NO: 30651 - protein, 15 aa, Artificial Sequence
  Description of Artificial Sequence: Synthetic peptide
  XENP021086 vlCDR1
KASQSVDWDGDSYMN

SEQ ID NO: 30652 - protein, 7 aa, Artificial Sequence
  Description of Artificial Sequence: Synthetic peptide
  XENP021086 vlCDR2
AASNLES

SEQ ID NO: 30653 - protein, 9 aa, Artificial Sequence
  Description of Artificial Sequence: Synthetic peptide
  XENP021086 vlCDR3
QQSNEDPFT

SEQ ID NO: 30654 - protein, 226 aa, Artificial Sequence; identical to SEQ ID NO: 29134
  Description of Artificial Sequence: Synthetic polypeptide
  XENP021087 7G8_H0_L0.14_Fab Heavy Chain

SEQ ID NO: 30655 - protein, 121 aa, Artificial Sequence; identical to SEQ ID NO: 17586
  Description of Artificial Sequence: Synthetic polypeptide
  VH of XENP021087

SEQ ID NO: 30656 - protein, 5 aa, Artificial Sequence
  Description of Artificial Sequence: Synthetic peptide
  XENP021087 vhCDR1
DAWMD

SEQ ID NO: 30657 - protein, 19 aa, Artificial Sequence
  Description of Artificial Sequence: Synthetic peptide
  XENP021087 vhCDR2
EIRTKANNHATYYAESVKG

SEQ ID NO: 30658 - protein, 10 aa, Artificial Sequence
  Description of Artificial Sequence: Synthetic peptide
  XENP021087 vhCDR3
LANWDWYFDV

SEQ ID NO: 30659 - protein, 218 aa, Artificial Sequence; identical to SEQ ID NO: 19830
  Description of Artificial Sequence: Synthetic polypeptide
  XENP021087 7G8_H0_L0.14_Fab Light Chain

SEQ ID NO: 30660 - protein, 111 aa, Artificial Sequence; identical to SEQ ID NO: 19831
  Description of Artificial Sequence: Synthetic polypeptide
  VL of XENP021087

SEQ ID NO: 30661 - protein, 15 aa, Artificial Sequence
  Description of Artificial Sequence: Synthetic peptide
  XENP021087 vlCDR1
KASQSVDVDGDSYMN

SEQ ID NO: 30662 - protein, 7 aa, Artificial Sequence
  Description of Artificial Sequence: Synthetic peptide
  XENP021087 vlCDR2
AASNLES

SEQ ID NO: 30663 - protein, 9 aa, Artificial Sequence
  Description of Artificial Sequence: Synthetic peptide
  XENP021087 vlCDR3
QQSNEDPFT

SEQ ID NO: 30664 - protein, 226 aa, Artificial Sequence; identical to SEQ ID NO: 29134
  Description of Artificial Sequence: Synthetic polypeptide
  XENP021088 7G8_H0_L0.15_Fab Heavy Chain

SEQ ID NO: 30665 - protein, 121 aa, Artificial Sequence; identical to SEQ ID NO: 17586
  Description of Artificial Sequence: Synthetic polypeptide
  VH of XENP021088

SEQ ID NO: 30666 - protein, 5 aa, Artificial Sequence
  Description of Artificial Sequence: Synthetic peptide
  XENP021088 vhCDR1
DAWMD

SEQ ID NO: 30667 - protein, 19 aa, Artificial Sequence
  Description of Artificial Sequence: Synthetic peptide
  XENP021088 vhCDR2
EIRTKANNHATYYAESVKG

SEQ ID NO: 30668 - protein, 10 aa, Artificial Sequence
  Description of Artificial Sequence: Synthetic peptide
  XENP021088 vhCDR3
LANWDWYFDV

SEQ ID NO: 30669 - protein, 218 aa, Artificial Sequence; identical to SEQ ID NO: 19840
  Description of Artificial Sequence: Synthetic polypeptide
  XENP021088 7G8_H0_L0.15_Fab Light Chain

SEQ ID NO: 30670 - protein, 111 aa, Artificial Sequence; identical to SEQ ID NO: 19841
  Description of Artificial Sequence: Synthetic polypeptide
  VL of XENP021088

SEQ ID NO: 30671 - protein, 15 aa, Artificial Sequence
  Description of Artificial Sequence: Synthetic peptide
  XENP021088 vlCDR1
KASQSVDADGDSYMN

SEQ ID NO: 30672 - protein, 7 aa, Artificial Sequence
  Description of Artificial Sequence: Synthetic peptide
  XENP021088 vlCDR2
AASNLES

SEQ ID NO: 30673 - protein, 9 aa, Artificial Sequence
  Description of Artificial Sequence: Synthetic peptide
  XENP021088 vlCDR3
QQSNEDPFT

SEQ ID NO: 30674 - protein, 226 aa, Artificial Sequence; identical to SEQ ID NO: 29134
  Description of Artificial Sequence: Synthetic polypeptide
  XENP021089 7G8_H0_L0.16_Fab Heavy Chain

SEQ ID NO: 30675 - protein, 121 aa, Artificial Sequence; identical to SEQ ID NO: 17586
  Description of Artificial Sequence: Synthetic polypeptide
  VH of XENP021089

SEQ ID NO: 30676 - protein, 5 aa, Artificial Sequence
  Description of Artificial Sequence: Synthetic peptide
  XENP021089 vhCDR1
DAWMD

SEQ ID NO: 30677 - protein, 19 aa, Artificial Sequence
  Description of Artificial Sequence: Synthetic peptide
  XENP021089 vhCDR2
EIRTKANNHATYYAESVKG

SEQ ID NO: 30678 - protein, 10 aa, Artificial Sequence
  Description of Artificial Sequence: Synthetic peptide
  XENP021089 vhCDR3
LANWDWYFDV

SEQ ID NO: 30679 - protein, 218 aa, Artificial Sequence; identical to SEQ ID NO: 19850
  Description of Artificial Sequence: Synthetic polypeptide
  XENP021089 7G8_H0_L0.16_Fab Light Chain

SEQ ID NO: 30680 - protein, 111 aa, Artificial Sequence; identical to SEQ ID NO: 19851
  Description of Artificial Sequence: Synthetic polypeptide
  VL of XENP021089

SEQ ID NO: 30681 - protein, 15 aa, Artificial Sequence
  Description of Artificial Sequence: Synthetic peptide
  XENP021089 vlCDR1
KASQSVDQDGDSYMN

SEQ ID NO: 30682 - protein, 7 aa, Artificial Sequence
  Description of Artificial Sequence: Synthetic peptide
  XENP021089 vlCDR2
AASNLES

SEQ ID NO: 30683 - protein, 9 aa, Artificial Sequence
  Description of Artificial Sequence: Synthetic peptide
  XENP021089 vlCDR3
QQSNEDPFT

SEQ ID NO: 30684 - protein, 226 aa, Artificial Sequence; identical to SEQ ID NO: 29134
  Description of Artificial Sequence: Synthetic polypeptide
  XENP021090 7G8_H0_L0.17_Fab Heavy Chain

SEQ ID NO: 30685 - protein, 121 aa, Artificial Sequence; identical to SEQ ID NO: 17586
  Description of Artificial Sequence: Synthetic polypeptide
  VH of XENP021090

SEQ ID NO: 30686 - protein, 5 aa, Artificial Sequence
  Description of Artificial Sequence: Synthetic peptide
  XENP021090 vhCDR1
DAWMD

SEQ ID NO: 30687 - protein, 19 aa, Artificial Sequence
  Description of Artificial Sequence: Synthetic peptide
  XENP021090 vhCDR2
EIRTKANNHATYYAESVKG

SEQ ID NO: 30688 - protein, 10 aa, Artificial Sequence
  Description of Artificial Sequence: Synthetic peptide
  XENP021090 vhCDR3
LANWDWYFDV

SEQ ID NO: 30689 - protein, 218 aa, Artificial Sequence; identical to SEQ ID NO: 19860
  Description of Artificial Sequence: Synthetic polypeptide
  XENP021090 7G8_H0_L0.17_Fab Light Chain

SEQ ID NO: 30690 - protein, 111 aa, Artificial Sequence; identical to SEQ ID NO: 19861
  Description of Artificial Sequence: Synthetic polypeptide
  VL of XENP021090

SEQ ID NO: 30691 - protein, 15 aa, Artificial Sequence
  Description of Artificial Sequence: Synthetic peptide
  XENP021090 vlCDR1
KASQSVDDDGDSYMN

SEQ ID NO: 30692 - protein, 7 aa, Artificial Sequence
  Description of Artificial Sequence: Synthetic peptide
  XENP021090 vlCDR2
AASNLES

SEQ ID NO: 30693 - protein, 9 aa, Artificial Sequence
  Description of Artificial Sequence: Synthetic peptide
  XENP021090 vlCDR3
QQSNEDPFT

SEQ ID NO: 30694 - protein, 226 aa, Artificial Sequence; identical to SEQ ID NO: 29134
  Description of Artificial Sequence: Synthetic polypeptide
  XENP021091 7G8_H0_L0.18_Fab Heavy Chain

SEQ ID NO: 30695 - protein, 121 aa, Artificial Sequence; identical to SEQ ID NO: 17586
  Description of Artificial Sequence: Synthetic polypeptide
  VH of XENP021091

SEQ ID NO: 30696 - protein, 5 aa, Artificial Sequence
  Description of Artificial Sequence: Synthetic peptide
  XENP021091 vhCDR1
DAWMD

SEQ ID NO: 30697 - protein, 19 aa, Artificial Sequence
  Description of Artificial Sequence: Synthetic peptide
  XENP021091 vhCDR2
EIRTKANNHATYYAESVKG

SEQ ID NO: 30698 - protein, 10 aa, Artificial Sequence
  Description of Artificial Sequence: Synthetic peptide
  XENP021091 vhCDR3
LANWDWYFDV

SEQ ID NO: 30699 - protein, 218 aa, Artificial Sequence; identical to SEQ ID NO: 19870
  Description of Artificial Sequence: Synthetic polypeptide
  XENP021091 7G8_H0_L0.18_Fab Light Chain

SEQ ID NO: 30700 - protein, 111 aa, Artificial Sequence; identical to SEQ ID NO: 19871
  Description of Artificial Sequence: Synthetic polypeptide
  VL of XENP021091

SEQ ID NO: 30701 - protein, 15 aa, Artificial Sequence
  Description of Artificial Sequence: Synthetic peptide
  XENP021091 vlCDR1
KASQSVDKDGDSYMN

SEQ ID NO: 30702 - protein, 7 aa, Artificial Sequence
  Description of Artificial Sequence: Synthetic peptide
  XENP021091 vlCDR2
AASNLES

SEQ ID NO: 30703 - protein, 9 aa, Artificial Sequence
  Description of Artificial Sequence: Synthetic peptide
  XENP021091 vlCDR3
QQSNEDPFT

SEQ ID NO: 30704 - protein, 226 aa, Artificial Sequence; identical to SEQ ID NO: 29134
  Description of Artificial Sequence: Synthetic polypeptide
  XENP021092 7G8_H0_L0.19_Fab Heavy Chain

SEQ ID NO: 30705 - protein, 121 aa, Artificial Sequence; identical to SEQ ID NO: 17586
  Description of Artificial Sequence: Synthetic polypeptide
  VH of XENP021092

SEQ ID NO: 30706 - protein, 5 aa, Artificial Sequence
  Description of Artificial Sequence: Synthetic peptide
  XENP021092 vhCDR1
DAWMD

SEQ ID NO: 30707 - protein, 19 aa, Artificial Sequence
  Description of Artificial Sequence: Synthetic peptide
  XENP021092 vhCDR2
EIRTKANNHATYYAESVKG

SEQ ID NO: 30708 - protein, 10 aa, Artificial Sequence
  Description of Artificial Sequence: Synthetic peptide
  XENP021092 vhCDR3
LANWDWYFDV

SEQ ID NO: 30709 - protein, 218 aa, Artificial Sequence; identical to SEQ ID NO: 19880
  Description of Artificial Sequence: Synthetic polypeptide
  XENP021092 7G8_H0_L0.19_Fab Light Chain

SEQ ID NO: 30710 - protein, 111 aa, Artificial Sequence; identical to SEQ ID NO: 19881
  Description of Artificial Sequence: Synthetic polypeptide
  VL of XENP021092

SEQ ID NO: 30711 - protein, 15 aa, Artificial Sequence
  Description of Artificial Sequence: Synthetic peptide
  XENP021092 vlCDR1
KASQSVDNDGDSYMN

SEQ ID NO: 30712 - protein, 7 aa, Artificial Sequence
  Description of Artificial Sequence: Synthetic peptide
  XENP021092 vlCDR2
AASNLES

SEQ ID NO: 30713 - protein, 9 aa, Artificial Sequence
  Description of Artificial Sequence: Synthetic peptide
  XENP021092 vlCDR3
QQSNEDPFT

SEQ ID NO: 30714 - protein, 226 aa, Artificial Sequence; identical to SEQ ID NO: 29134
  Description of Artificial Sequence: Synthetic polypeptide
  XENP021093 7G8_H0_L0.20_Fab Heavy Chain

SEQ ID NO: 30715 - protein, 121 aa, Artificial Sequence; identical to SEQ ID NO: 17586
  Description of Artificial Sequence: Synthetic polypeptide
  VH of XENP021093

SEQ ID NO: 30716 - protein, 5 aa, Artificial Sequence
  Description of Artificial Sequence: Synthetic peptide
  XENP021093 vhCDR1
DAWMD

SEQ ID NO: 30717 - protein, 19 aa, Artificial Sequence
  Description of Artificial Sequence: Synthetic peptide
  XENP021093 vhCDR2
EIRTKANNHATYYAESVKG

SEQ ID NO: 30718 - protein, 10 aa, Artificial Sequence
  Description of Artificial Sequence: Synthetic peptide
  XENP021093 vhCDR3
LANWDWYFDV

SEQ ID NO: 30719 - protein, 218 aa, Artificial Sequence; identical to SEQ ID NO: 19890
  Description of Artificial Sequence: Synthetic polypeptide
  XENP021093 7G8_H0_L0.20_Fab Light Chain

SEQ ID NO: 30720 - protein, 111 aa, Artificial Sequence; identical to SEQ ID NO: 19891
  Description of Artificial Sequence: Synthetic polypeptide
  VL of XENP021093

SEQ ID NO: 30721 - protein, 15 aa, Artificial Sequence
  Description of Artificial Sequence: Synthetic peptide
  XENP021093 vlCDR1
KASQSVDYNGDSYMN

SEQ ID NO: 30722 - protein, 7 aa, Artificial Sequence
  Description of Artificial Sequence: Synthetic peptide
  XENP021093 vlCDR2
AASNLES

SEQ ID NO: 30723 - protein, 9 aa, Artificial Sequence
  Description of Artificial Sequence: Synthetic peptide
  XENP021093 vlCDR3
QQSNEDPFT

SEQ ID NO: 30724 - protein, 226 aa, Artificial Sequence; identical to SEQ ID NO: 29134
  Description of Artificial Sequence: Synthetic polypeptide
  XENP021094 7G8_H0_L0.21_Fab Heavy Chain

SEQ ID NO: 30725 - protein, 121 aa, Artificial Sequence; identical to SEQ ID NO: 17586
  Description of Artificial Sequence: Synthetic polypeptide
  VH of XENP021094

SEQ ID NO: 30726 - protein, 5 aa, Artificial Sequence
  Description of Artificial Sequence: Synthetic peptide
  XENP021094 vhCDR1
DAWMD

SEQ ID NO: 30727 - protein, 19 aa, Artificial Sequence
  Description of Artificial Sequence: Synthetic peptide
  XENP021094 vhCDR2
EIRTKANNHATYYAESVKG

SEQ ID NO: 30728 - protein, 10 aa, Artificial Sequence
  Description of Artificial Sequence: Synthetic peptide
  XENP021094 vhCDR3
LANWDWYFDV

SEQ ID NO: 30729 - protein, 218 aa, Artificial Sequence; identical to SEQ ID NO: 19900
  Description of Artificial Sequence: Synthetic polypeptide
  XENP021094 7G8_H0_L0.21_Fab Light Chain

SEQ ID NO: 30730 - protein, 111 aa, Artificial Sequence; identical to SEQ ID NO: 19901
  Description of Artificial Sequence: Synthetic polypeptide
  VL of XENP021094

SEQ ID NO: 30731 - protein, 15 aa, Artificial Sequence
  Description of Artificial Sequence: Synthetic peptide
  XENP021094 vlCDR1
KASQSVDYEGDSYMN

SEQ ID NO: 30732 - protein, 7 aa, Artificial Sequence
  Description of Artificial Sequence: Synthetic peptide
  XENP021094 vlCDR2
AASNLES

SEQ ID NO: 30733 - protein, 9 aa, Artificial Sequence
  Description of Artificial Sequence: Synthetic peptide
  XENP021094 vlCDR3
QQSNEDPFT

SEQ ID NO: 30734 - protein, 226 aa, Artificial Sequence; identical to SEQ ID NO: 29134
  Description of Artificial Sequence: Synthetic polypeptide
  XENP021095 7G8_H0_L0.22_Fab Heavy Chain

SEQ ID NO: 30735 - protein, 121 aa, Artificial Sequence; identical to SEQ ID NO: 17586
  Description of Artificial Sequence: Synthetic polypeptide
  VH of XENP021095

SEQ ID NO: 30736 - protein, 5 aa, Artificial Sequence
  Description of Artificial Sequence: Synthetic peptide
  XENP021095 vhCDR1
DAWMD

SEQ ID NO: 30737 - protein, 19 aa, Artificial Sequence
  Description of Artificial Sequence: Synthetic peptide
  XENP021095 vhCDR2
EIRTKANNHATYYAESVKG

SEQ ID NO: 30738 - protein, 10 aa, Artificial Sequence
  Description of Artificial Sequence: Synthetic peptide
  XENP021095 vhCDR3
LANWDWYFDV

SEQ ID NO: 30739 - protein, 218 aa, Artificial Sequence; identical to SEQ ID NO: 19910
  Description of Artificial Sequence: Synthetic polypeptide
  XENP021095 7G8_H0_L0.22_Fab Light Chain

SEQ ID NO: 30740 - protein, 111 aa, Artificial Sequence; identical to SEQ ID NO: 19911
  Description of Artificial Sequence: Synthetic polypeptide
  VL of XENP021095

SEQ ID NO: 30741 - protein, 15 aa, Artificial Sequence
  Description of Artificial Sequence: Synthetic peptide
  XENP021095 vlCDR1
KASQSVDYHGDSYMN

SEQ ID NO: 30742 - protein, 7 aa, Artificial Sequence
  Description of Artificial Sequence: Synthetic peptide
  XENP021095 vlCDR2
AASNLES

SEQ ID NO: 30743 - protein, 9 aa, Artificial Sequence
  Description of Artificial Sequence: Synthetic peptide
  XENP021095 vlCDR3
QQSNEDPFT

SEQ ID NO: 30744 - protein, 226 aa, Artificial Sequence; identical to SEQ ID NO: 29134
  Description of Artificial Sequence: Synthetic polypeptide
  XENP021096 7G8_H0_L0.23_Fab Heavy Chain

SEQ ID NO: 30745 - protein, 121 aa, Artificial Sequence; identical to SEQ ID NO: 17586
  Description of Artificial Sequence: Synthetic polypeptide
  VH of XENP021096

SEQ ID NO: 30746 - protein, 5 aa, Artificial Sequence
  Description of Artificial Sequence: Synthetic peptide
  XENP021096 vhCDR1
DAWMD

SEQ ID NO: 30747 - protein, 19 aa, Artificial Sequence
  Description of Artificial Sequence: Synthetic peptide
  XENP021096 vhCDR2
EIRTKANNHATYYAESVKG

SEQ ID NO: 30748 - protein, 10 aa, Artificial Sequence
  Description of Artificial Sequence: Synthetic peptide
  XENP021096 vhCDR3
LANWDWYFDV

SEQ ID NO: 30749 - protein, 218 aa, Artificial Sequence; identical to SEQ ID NO: 19920
  Description of Artificial Sequence: Synthetic polypeptide
  XENP021096 7G8_H0_L0.23_Fab Light Chain

SEQ ID NO: 30750 - protein, 111 aa, Artificial Sequence; identical to SEQ ID NO: 19921
  Description of Artificial Sequence: Synthetic polypeptide
  VL of XENP021096

SEQ ID NO: 30751 - protein, 15 aa, Artificial Sequence
  Description of Artificial Sequence: Synthetic peptide
  XENP021096 vlCDR1
KASQSVDYSGDSYMN

SEQ ID NO: 30752 - protein, 7 aa, Artificial Sequence
  Description of Artificial Sequence: Synthetic peptide
  XENP021096 vlCDR2
AASNLES

SEQ ID NO: 30753 - protein, 9 aa, Artificial Sequence
  Description of Artificial Sequence: Synthetic peptide
  XENP021096 vlCDR3
QQSNEDPFT

SEQ ID NO: 30754 - protein, 226 aa, Artificial Sequence; identical to SEQ ID NO: 29134
  Description of Artificial Sequence: Synthetic polypeptide
  XENP021101 7G8_H0_L0.24_Fab Heavy Chain

SEQ ID NO: 30755 - protein, 121 aa, Artificial Sequence; identical to SEQ ID NO: 17586
  Description of Artificial Sequence: Synthetic polypeptide
  VH of XENP021101

SEQ ID NO: 30756 - protein, 5 aa, Artificial Sequence
  Description of Artificial Sequence: Synthetic peptide
  XENP021101 vhCDR1
DAWMD

SEQ ID NO: 30757 - protein, 19 aa, Artificial Sequence
  Description of Artificial Sequence: Synthetic peptide
  XENP021101 vhCDR2
EIRTKANNHATYYAESVKG

SEQ ID NO: 30758 - protein, 10 aa, Artificial Sequence
  Description of Artificial Sequence: Synthetic peptide
  XENP021101 vhCDR3
LANWDWYFDV

SEQ ID NO: 30759 - protein, 218 aa, Artificial Sequence; identical to SEQ ID NO: 19930
  Description of Artificial Sequence: Synthetic polypeptide
  XENP021101 7G8_H0_L0.24_Fab Light Chain

SEQ ID NO: 30760 - protein, 111 aa, Artificial Sequence; identical to SEQ ID NO: 19931
  Description of Artificial Sequence: Synthetic polypeptide
  VL of XENP021101

SEQ ID NO: 30761 - protein, 15 aa, Artificial Sequence
  Description of Artificial Sequence: Synthetic peptide
  XENP021101 vlCDR1
KASQSVDYRGDSYMN

SEQ ID NO: 30762 - protein, 7 aa, Artificial Sequence
  Description of Artificial Sequence: Synthetic peptide
  XENP021101 vlCDR2
AASNLES

SEQ ID NO: 30763 - protein, 9 aa, Artificial Sequence
  Description of Artificial Sequence: Synthetic peptide
  XENP021101 vlCDR3
QQSNEDPFT

SEQ ID NO: 30764 - protein, 226 aa, Artificial Sequence; identical to SEQ ID NO: 29134
  Description of Artificial Sequence: Synthetic polypeptide
  XENP021102 7G8_H0_L0.25_Fab Heavy Chain

SEQ ID NO: 30765 - protein, 121 aa, Artificial Sequence; identical to SEQ ID NO: 17586
  Description of Artificial Sequence: Synthetic polypeptide
  VH of XENP021102

SEQ ID NO: 30766 - protein, 5 aa, Artificial Sequence
  Description of Artificial Sequence: Synthetic peptide
  XENP021102 vhCDR1
DAWMD

SEQ ID NO: 30767 - protein, 19 aa, Artificial Sequence
  Description of Artificial Sequence: Synthetic peptide
  XENP021102 vhCDR2
EIRTKANNHATYYAESVKG

SEQ ID NO: 30768 - protein, 10 aa, Artificial Sequence
  Description of Artificial Sequence: Synthetic peptide
  XENP021102 vhCDR3
LANWDWYFDV

SEQ ID NO: 30769 - protein, 218 aa, Artificial Sequence; identical to SEQ ID NO: 19940
  Description of Artificial Sequence: Synthetic polypeptide
  XENP021102 7G8_H0_L0.25_Fab Light Chain

SEQ ID NO: 30770 - protein, 111 aa, Artificial Sequence; identical to SEQ ID NO: 19941
  Description of Artificial Sequence: Synthetic polypeptide
  VL of XENP021102

SEQ ID NO: 30771 - protein, 15 aa, Artificial Sequence
  Description of Artificial Sequence: Synthetic peptide
  XENP021102 vlCDR1
KASQSVDYLGDSYMN

SEQ ID NO: 30772 - protein, 7 aa, Artificial Sequence
  Description of Artificial Sequence: Synthetic peptide
  XENP021102 vlCDR2
AASNLES

SEQ ID NO: 30773 - protein, 9 aa, Artificial Sequence
  Description of Artificial Sequence: Synthetic peptide
  XENP021102 vlCDR3
QQSNEDPFT

SEQ ID NO: 30774 - protein, 226 aa, Artificial Sequence; identical to SEQ ID NO: 29134
  Description of Artificial Sequence: Synthetic polypeptide
  XENP021103 7G8_H0_L0.26_Fab Heavy Chain

SEQ ID NO: 30775 - protein, 121 aa, Artificial Sequence; identical to SEQ ID NO: 17586
  Description of Artificial Sequence: Synthetic polypeptide
  VH of XENP021103

SEQ ID NO: 30776 - protein, 5 aa, Artificial Sequence
  Description of Artificial Sequence: Synthetic peptide
  XENP021103 vhCDR1
DAWMD

SEQ ID NO: 30777 - protein, 19 aa, Artificial Sequence
  Description of Artificial Sequence: Synthetic peptide
  XENP021103 vhCDR2
EIRTKANNHATYYAESVKG

SEQ ID NO: 30778 - protein, 10 aa, Artificial Sequence
  Description of Artificial Sequence: Synthetic peptide
  XENP021103 vhCDR3
LANWDWYFDV

SEQ ID NO: 30779 - protein, 218 aa, Artificial Sequence; identical to SEQ ID NO: 19950
  Description of Artificial Sequence: Synthetic polypeptide
  XENP021103 7G8_H0_L0.26_Fab Light Chain

SEQ ID NO: 30780 - protein, 111 aa, Artificial Sequence; identical to SEQ ID NO: 19951
  Description of Artificial Sequence: Synthetic polypeptide
  VL of XENP021103

SEQ ID NO: 30781 - protein, 15 aa, Artificial Sequence
  Description of Artificial Sequence: Synthetic peptide
  XENP021103 vlCDR1
KASQSVDYTGDSYMN

SEQ ID NO: 30782 - protein, 7 aa, Artificial Sequence
  Description of Artificial Sequence: Synthetic peptide
  XENP021103 vlCDR2
AASNLES

SEQ ID NO: 30783 - protein, 9 aa, Artificial Sequence
  Description of Artificial Sequence: Synthetic peptide
  XENP021103 vlCDR3
QQSNEDPFT

SEQ ID NO: 30784 - protein, 226 aa, Artificial Sequence; identical to SEQ ID NO: 29134
  Description of Artificial Sequence: Synthetic polypeptide
  XENP021104 7G8_H0_L0.27_Fab Heavy Chain

SEQ ID NO: 30785 - protein, 121 aa, Artificial Sequence; identical to SEQ ID NO: 17586
  Description of Artificial Sequence: Synthetic polypeptide
  VH of XENP021104

SEQ ID NO: 30786 - protein, 5 aa, Artificial Sequence
  Description of Artificial Sequence: Synthetic peptide
  XENP021104 vhCDR1
DAWMD

SEQ ID NO: 30787 - protein, 19 aa, Artificial Sequence
  Description of Artificial Sequence: Synthetic peptide
  XENP021104 vhCDR2
EIRTKANNHATYYAESVKG

SEQ ID NO: 30788 - protein, 10 aa, Artificial Sequence
  Description of Artificial Sequence: Synthetic peptide
  XENP021104 vhCDR3
LANWDWYFDV

SEQ ID NO: 30789 - protein, 218 aa, Artificial Sequence; identical to SEQ ID NO: 19960
  Description of Artificial Sequence: Synthetic polypeptide
  XENP021104 7G8_H0_L0.27_Fab Light Chain

SEQ ID NO: 30790 - protein, 111 aa, Artificial Sequence; identical to SEQ ID NO: 19961
  Description of Artificial Sequence: Synthetic polypeptide
  VL of XENP021104

SEQ ID NO: 30791 - protein, 15 aa, Artificial Sequence
  Description of Artificial Sequence: Synthetic peptide
  XENP021104 vlCDR1
KASQSVDYGGDSYMN

SEQ ID NO: 30792 - protein, 7 aa, Artificial Sequence
  Description of Artificial Sequence: Synthetic peptide
  XENP021104 vlCDR2
AASNLES

SEQ ID NO: 30793 - protein, 9 aa, Artificial Sequence
  Description of Artificial Sequence: Synthetic peptide
  XENP021104 vlCDR3
QQSNEDPFT

SEQ ID NO: 30794 - protein, 226 aa, Artificial Sequence; identical to SEQ ID NO: 29134
  Description of Artificial Sequence: Synthetic polypeptide
  XENP021105 7G8_H0_L0.28_Fab Heavy Chain

SEQ ID NO: 30795 - protein, 121 aa, Artificial Sequence; identical to SEQ ID NO: 17586
  Description of Artificial Sequence: Synthetic polypeptide
  VH of XENP021105

SEQ ID NO: 30796 - protein, 5 aa, Artificial Sequence
  Description of Artificial Sequence: Synthetic peptide
  XENP021105 vhCDR1
DAWMD

SEQ ID NO: 30797 - protein, 19 aa, Artificial Sequence
  Description of Artificial Sequence: Synthetic peptide
  XENP021105 vhCDR2
EIRTKANNHATYYAESVKG

SEQ ID NO: 30798 - protein, 10 aa, Artificial Sequence
  Description of Artificial Sequence: Synthetic peptide
  XENP021105 vhCDR3
LANWDWYFDV

SEQ ID NO: 30799 - protein, 218 aa, Artificial Sequence; identical to SEQ ID NO: 19970
  Description of Artificial Sequence: Synthetic polypeptide
  XENP021105 7G8_H0_L0.28_Fab Light Chain

SEQ ID NO: 30800 - protein, 111 aa, Artificial Sequence; identical to SEQ ID NO: 19971
  Description of Artificial Sequence: Synthetic polypeptide
  VL of XENP021105

SEQ ID NO: 30801 - protein, 15 aa, Artificial Sequence
  Description of Artificial Sequence: Synthetic peptide
  XENP021105 vlCDR1
KASQSVDYYGDSYMN

SEQ ID NO: 30802 - protein, 7 aa, Artificial Sequence
  Description of Artificial Sequence: Synthetic peptide
  XENP021105 vlCDR2
AASNLES

SEQ ID NO: 30803 - protein, 9 aa, Artificial Sequence
  Description of Artificial Sequence: Synthetic peptide
  XENP021105 vlCDR3
QQSNEDPFT

SEQ ID NO: 30804 - protein, 226 aa, Artificial Sequence; identical to SEQ ID NO: 29134
  Description of Artificial Sequence: Synthetic polypeptide
  XENP021106 7G8_H0_L0.29_Fab Heavy Chain

SEQ ID NO: 30805 - protein, 121 aa, Artificial Sequence; identical to SEQ ID NO: 17586
  Description of Artificial Sequence: Synthetic polypeptide
  VH of XENP021106

SEQ ID NO: 30806 - protein, 5 aa, Artificial Sequence
  Description of Artificial Sequence: Synthetic peptide
  XENP021106 vhCDR1
DAWMD

SEQ ID NO: 30807 - protein, 19 aa, Artificial Sequence
  Description of Artificial Sequence: Synthetic peptide
  XENP021106 vhCDR2
EIRTKANNHATYYAESVKG

SEQ ID NO: 30808 - protein, 10 aa, Artificial Sequence
  Description of Artificial Sequence: Synthetic peptide
  XENP021106 vhCDR3
LANWDWYFDV

SEQ ID NO: 30809 - protein, 218 aa, Artificial Sequence; identical to SEQ ID NO: 19980
  Description of Artificial Sequence: Synthetic polypeptide
  XENP021106 7G8_H0_L0.29_Fab Light Chain

SEQ ID NO: 30810 - protein, 111 aa, Artificial Sequence; identical to SEQ ID NO: 19981
  Description of Artificial Sequence: Synthetic polypeptide
  VL of XENP021106

SEQ ID NO: 30811 - protein, 15 aa, Artificial Sequence
  Description of Artificial Sequence: Synthetic peptide
  XENP021106 vlCDR1
KASQSVDYDADSYMN

SEQ ID NO: 30812 - protein, 7 aa, Artificial Sequence
  Description of Artificial Sequence: Synthetic peptide
  XENP021106 vlCDR2
AASNLES

SEQ ID NO: 30813 - protein, 9 aa, Artificial Sequence
  Description of Artificial Sequence: Synthetic peptide
  XENP021106 vlCDR3
QQSNEDPFT

SEQ ID NO: 30814 - protein, 226 aa, Artificial Sequence; identical to SEQ ID NO: 29134
  Description of Artificial Sequence: Synthetic polypeptide
  XENP021107 7G8_H0_L0.30_Fab Heavy Chain

SEQ ID NO: 30815 - protein, 121 aa, Artificial Sequence; identical to SEQ ID NO: 17586
  Description of Artificial Sequence: Synthetic polypeptide
  VH of XENP021107

SEQ ID NO: 30816 - protein, 5 aa, Artificial Sequence
  Description of Artificial Sequence: Synthetic peptide
  XENP021107 vhCDR1
DAWMD

SEQ ID NO: 30817 - protein, 19 aa, Artificial Sequence
  Description of Artificial Sequence: Synthetic peptide
  XENP021107 vhCDR2
EIRTKANNHATYYAESVKG

SEQ ID NO: 30818 - protein, 10 aa, Artificial Sequence
  Description of Artificial Sequence: Synthetic peptide
  XENP021107 vhCDR3
LANWDWYFDV

SEQ ID NO: 30819 - protein, 218 aa, Artificial Sequence; identical to SEQ ID NO: 19990
  Description of Artificial Sequence: Synthetic polypeptide
  XENP021107 7G8_H0_L0.30_Fab Light Chain

SEQ ID NO: 30820 - protein, 111 aa, Artificial Sequence; identical to SEQ ID NO: 19991
  Description of Artificial Sequence: Synthetic polypeptide
  VL of XENP021107

SEQ ID NO: 30821 - protein, 15 aa, Artificial Sequence
  Description of Artificial Sequence: Synthetic peptide
  XENP021107 vlCDR1
KASQSVDYDSDSYMN

SEQ ID NO: 30822 - protein, 7 aa, Artificial Sequence
  Description of Artificial Sequence: Synthetic peptide
  XENP021107 vlCDR2
AASNLES

SEQ ID NO: 30823 - protein, 9 aa, Artificial Sequence
  Description of Artificial Sequence: Synthetic peptide
  XENP021107 vlCDR3
QQSNEDPFT

SEQ ID NO: 30824 - protein, 226 aa, Artificial Sequence; identical to SEQ ID NO: 29134
  Description of Artificial Sequence: Synthetic polypeptide
  XENP021108 7G8_H0_L0.31_Fab Heavy Chain

SEQ ID NO: 30825 - protein, 121 aa, Artificial Sequence; identical to SEQ ID NO: 17586
  Description of Artificial Sequence: Synthetic polypeptide
  VH of XENP021108

SEQ ID NO: 30826 - protein, 5 aa, Artificial Sequence
  Description of Artificial Sequence: Synthetic peptide
  XENP021108 vhCDR1
DAWMD

SEQ ID NO: 30827 - protein, 19 aa, Artificial Sequence
  Description of Artificial Sequence: Synthetic peptide
  XENP021108 vhCDR2
EIRTKANNHATYYAESVKG

SEQ ID NO: 30828 - protein, 10 aa, Artificial Sequence
  Description of Artificial Sequence: Synthetic peptide
  XENP021108 vhCDR3
LANWDWYFDV

SEQ ID NO: 30829 - protein, 218 aa, Artificial Sequence; identical to SEQ ID NO: 20000
  Description of Artificial Sequence: Synthetic polypeptide
  XENP021108 7G8_H0_L0.31_Fab Light Chain

SEQ ID NO: 30830 - protein, 111 aa, Artificial Sequence; identical to SEQ ID NO: 20001
  Description of Artificial Sequence: Synthetic polypeptide
  VL of XENP021108

SEQ ID NO: 30831 - protein, 15 aa, Artificial Sequence
  Description of Artificial Sequence: Synthetic peptide
  XENP021108 vlCDR1
KASQSVDYDTDSYMN

SEQ ID NO: 30832 - protein, 7 aa, Artificial Sequence
  Description of Artificial Sequence: Synthetic peptide
  XENP021108 vlCDR2
AASNLES

SEQ ID NO: 30833 - protein, 9 aa, Artificial Sequence
  Description of Artificial Sequence: Synthetic peptide
  XENP021108 vlCDR3
QQSNEDPFT

SEQ ID NO: 30834 - protein, 226 aa, Artificial Sequence; identical to SEQ ID NO: 29134
  Description of Artificial Sequence: Synthetic polypeptide
  XENP021109 7G8_H0_L0.32_Fab Heavy Chain

SEQ ID NO: 30835 - protein, 121 aa, Artificial Sequence; identical to SEQ ID NO: 17586
  Description of Artificial Sequence: Synthetic polypeptide
  VH of XENP021109

SEQ ID NO: 30836 - protein, 5 aa, Artificial Sequence
  Description of Artificial Sequence: Synthetic peptide
  XENP021109 vhCDR1
DAWMD

SEQ ID NO: 30837 - protein, 19 aa, Artificial Sequence
  Description of Artificial Sequence: Synthetic peptide
  XENP021109 vhCDR2
EIRTKANNHATYYAESVKG

SEQ ID NO: 30838 - protein, 10 aa, Artificial Sequence
  Description of Artificial Sequence: Synthetic peptide
  XENP021109 vhCDR3
LANWDWYFDV

SEQ ID NO: 30839 - protein, 218 aa, Artificial Sequence; identical to SEQ ID NO: 20010
  Description of Artificial Sequence: Synthetic polypeptide
  XENP021109 7G8_H0_L0.32_Fab Light Chain

SEQ ID NO: 30840 - protein, 111 aa, Artificial Sequence; identical to SEQ ID NO: 20011
  Description of Artificial Sequence: Synthetic polypeptide
  VL of XENP021109

SEQ ID NO: 30841 - protein, 15 aa, Artificial Sequence
  Description of Artificial Sequence: Synthetic peptide
  XENP021109 vlCDR1
KASQSVDYDQDSYMN

SEQ ID NO: 30842 - protein, 7 aa, Artificial Sequence
  Description of Artificial Sequence: Synthetic peptide
  XENP021109 vlCDR2
AASNLES

SEQ ID NO: 30843 - protein, 9 aa, Artificial Sequence
  Description of Artificial Sequence: Synthetic peptide
  XENP021109 vlCDR3
QQSNEDPFT

SEQ ID NO: 30844 - protein, 226 aa, Artificial Sequence; identical to SEQ ID NO: 29134
  Description of Artificial Sequence: Synthetic polypeptide
  XENP021110 7G8_H0_L0.33_Fab Heavy Chain

SEQ ID NO: 30845 - protein, 121 aa, Artificial Sequence; identical to SEQ ID NO: 17586
  Description of Artificial Sequence: Synthetic polypeptide
  VH of XENP021110

SEQ ID NO: 30846 - protein, 5 aa, Artificial Sequence
  Description of Artificial Sequence: Synthetic peptide
  XENP021110 vhCDR1
DAWMD

SEQ ID NO: 30847 - protein, 19 aa, Artificial Sequence
  Description of Artificial Sequence: Synthetic peptide
  XENP021110 vhCDR2
EIRTKANNHATYYAESVKG

SEQ ID NO: 30848 - protein, 10 aa, Artificial Sequence
  Description of Artificial Sequence: Synthetic peptide
  XENP021110 vhCDR3
LANWDWYFDV

SEQ ID NO: 30849 - protein, 218 aa, Artificial Sequence; identical to SEQ ID NO: 20020
  Description of Artificial Sequence: Synthetic polypeptide
  XENP021110 7G8_H0_L0.33_Fab Light Chain

SEQ ID NO: 30850 - protein, 111 aa, Artificial Sequence; identical to SEQ ID NO: 20021
  Description of Artificial Sequence: Synthetic polypeptide
  VL of XENP021110

SEQ ID NO: 30851 - protein, 15 aa, Artificial Sequence
  Description of Artificial Sequence: Synthetic peptide
  XENP021110 vlCDR1
KASQSVDYDHDSYMN

SEQ ID NO: 30852 - protein, 7 aa, Artificial Sequence
  Description of Artificial Sequence: Synthetic peptide
  XENP021110 vlCDR2
AASNLES

SEQ ID NO: 30853 - protein, 9 aa, Artificial Sequence
  Description of Artificial Sequence: Synthetic peptide
  XENP021110 vlCDR3
QQSNEDPFT

SEQ ID NO: 30854 - protein, 226 aa, Artificial Sequence; identical to SEQ ID NO: 29134
  Description of Artificial Sequence: Synthetic polypeptide
  XENP021111 7G8_H0_L0.34_Fab Heavy Chain

SEQ ID NO: 30855 - protein, 121 aa, Artificial Sequence; identical to SEQ ID NO: 17586
  Description of Artificial Sequence: Synthetic polypeptide
  VH of XENP021111

SEQ ID NO: 30856 - protein, 5 aa, Artificial Sequence
  Description of Artificial Sequence: Synthetic peptide
  XENP021111 vhCDR1
DAWMD

SEQ ID NO: 30857 - protein, 19 aa, Artificial Sequence
  Description of Artificial Sequence: Synthetic peptide
  XENP021111 vhCDR2
EIRTKANNHATYYAESVKG

SEQ ID NO: 30858 - protein, 10 aa, Artificial Sequence
  Description of Artificial Sequence: Synthetic peptide
  XENP021111 vhCDR3
LANWDWYFDV

SEQ ID NO: 30859 - protein, 218 aa, Artificial Sequence; identical to SEQ ID NO: 20030
  Description of Artificial Sequence: Synthetic polypeptide
  XENP021111 7G8_H0_L0.34_Fab Light Chain

SEQ ID NO: 30860 - protein, 111 aa, Artificial Sequence; identical to SEQ ID NO: 20031
  Description of Artificial Sequence: Synthetic polypeptide
  VL of XENP021111

SEQ ID NO: 30861 - protein, 15 aa, Artificial Sequence
  Description of Artificial Sequence: Synthetic peptide
  XENP021111 vlCDR1
KASQSVDYDDDSYMN

SEQ ID NO: 30862 - protein, 7 aa, Artificial Sequence
  Description of Artificial Sequence: Synthetic peptide
  XENP021111 vlCDR2
AASNLES

SEQ ID NO: 30863 - protein, 9 aa, Artificial Sequence
  Description of Artificial Sequence: Synthetic peptide
  XENP021111 vlCDR3
QQSNEDPFT

SEQ ID NO: 30864 - protein, 226 aa, Artificial Sequence; identical to SEQ ID NO: 29134
  Description of Artificial Sequence: Synthetic polypeptide
  XENP021112 7G8_H0_L0.35_Fab Heavy Chain

SEQ ID NO: 30865 - protein, 121 aa, Artificial Sequence; identical to SEQ ID NO: 17586
  Description of Artificial Sequence: Synthetic polypeptide
  VH of XENP021112

SEQ ID NO: 30866 - protein, 5 aa, Artificial Sequence
  Description of Artificial Sequence: Synthetic peptide
  XENP021112 vhCDR1
DAWMD

SEQ ID NO: 30867 - protein, 19 aa, Artificial Sequence
  Description of Artificial Sequence: Synthetic peptide
  XENP021112 vhCDR2
EIRTKANNHATYYAESVKG

SEQ ID NO: 30868 - protein, 10 aa, Artificial Sequence
  Description of Artificial Sequence: Synthetic peptide
  XENP021112 vhCDR3
LANWDWYFDV

SEQ ID NO: 30869 - protein, 218 aa, Artificial Sequence; identical to SEQ ID NO: 20040
  Description of Artificial Sequence: Synthetic polypeptide
  XENP021112 7G8_H0_L0.35_Fab Light Chain

SEQ ID NO: 30870 - protein, 111 aa, Artificial Sequence; identical to SEQ ID NO: 20041
  Description of Artificial Sequence: Synthetic polypeptide
  VL of XENP021112

SEQ ID NO: 30871 - protein, 15 aa, Artificial Sequence
  Description of Artificial Sequence: Synthetic peptide
  XENP021112 vlCDR1
KASQSVDYDKDSYMN

SEQ ID NO: 30872 - protein, 7 aa, Artificial Sequence
  Description of Artificial Sequence: Synthetic peptide
  XENP021112 vlCDR2
AASNLES

SEQ ID NO: 30873 - protein, 9 aa, Artificial Sequence
  Description of Artificial Sequence: Synthetic peptide
  XENP021112 vlCDR3
QQSNEDPFT

SEQ ID NO: 30874 - protein, 226 aa, Artificial Sequence; identical to SEQ ID NO: 29134
  Description of Artificial Sequence: Synthetic polypeptide
  XENP021113 7G8_H0_L0.36_Fab Heavy Chain

SEQ ID NO: 30875 - protein, 121 aa, Artificial Sequence; identical to SEQ ID NO: 17586
  Description of Artificial Sequence: Synthetic polypeptide
  VH of XENP021113

SEQ ID NO: 30876 - protein, 5 aa, Artificial Sequence
  Description of Artificial Sequence: Synthetic peptide
  XENP021113 vhCDR1
DAWMD

SEQ ID NO: 30877 - protein, 19 aa, Artificial Sequence
  Description of Artificial Sequence: Synthetic peptide
  XENP021113 vhCDR2
EIRTKANNHATYYAESVKG

SEQ ID NO: 30878 - protein, 10 aa, Artificial Sequence
  Description of Artificial Sequence: Synthetic peptide
  XENP021113 vhCDR3
LANWDWYFDV

SEQ ID NO: 30879 - protein, 218 aa, Artificial Sequence; identical to SEQ ID NO: 20050
  Description of Artificial Sequence: Synthetic polypeptide
  XENP021113 7G8_H0_L0.36_Fab Light Chain

SEQ ID NO: 30880 - protein, 111 aa, Artificial Sequence; identical to SEQ ID NO: 20051
  Description of Artificial Sequence: Synthetic polypeptide
  VL of XENP021113

SEQ ID NO: 30881 - protein, 15 aa, Artificial Sequence
  Description of Artificial Sequence: Synthetic peptide
  XENP021113 vlCDR1
KASQSVDYDLDSYMN

SEQ ID NO: 30882 - protein, 7 aa, Artificial Sequence
  Description of Artificial Sequence: Synthetic peptide
  XENP021113 vlCDR2
AASNLES

SEQ ID NO: 30883 - protein, 9 aa, Artificial Sequence
  Description of Artificial Sequence: Synthetic peptide
  XENP021113 vlCDR3
QQSNEDPFT

SEQ ID NO: 30884 - protein, 226 aa, Artificial Sequence; identical to SEQ ID NO: 29134
  Description of Artificial Sequence: Synthetic polypeptide
  XENP021114 7G8_H0_L0.37_Fab Heavy Chain

SEQ ID NO: 30885 - protein, 121 aa, Artificial Sequence; identical to SEQ ID NO: 17586
  Description of Artificial Sequence: Synthetic polypeptide
  VH of XENP021114

SEQ ID NO: 30886 - protein, 5 aa, Artificial Sequence
  Description of Artificial Sequence: Synthetic peptide
  XENP021114 vhCDR1
DAWMD

SEQ ID NO: 30887 - protein, 19 aa, Artificial Sequence
  Description of Artificial Sequence: Synthetic peptide
  XENP021114 vhCDR2
EIRTKANNHATYYAESVKG

SEQ ID NO: 30888 - protein, 10 aa, Artificial Sequence
  Description of Artificial Sequence: Synthetic peptide
  XENP021114 vhCDR3
LANWDWYFDV

SEQ ID NO: 30889 - protein, 218 aa, Artificial Sequence; identical to SEQ ID NO: 20060
  Description of Artificial Sequence: Synthetic polypeptide
  XENP021114 7G8_H0_L0.37_Fab Light Chain

SEQ ID NO: 30890 - protein, 111 aa, Artificial Sequence; identical to SEQ ID NO: 20061
  Description of Artificial Sequence: Synthetic polypeptide
  VL of XENP021114

SEQ ID NO: 30891 - protein, 15 aa, Artificial Sequence
  Description of Artificial Sequence: Synthetic peptide
  XENP021114 vlCDR1
KASQSVDYDYDSYMN

SEQ ID NO: 30892 - protein, 7 aa, Artificial Sequence
  Description of Artificial Sequence: Synthetic peptide
  XENP021114 vlCDR2
AASNLES

SEQ ID NO: 30893 - protein, 9 aa, Artificial Sequence
  Description of Artificial Sequence: Synthetic peptide
  XENP021114 vlCDR3
QQSNEDPFT

SEQ ID NO: 30894 - protein, 226 aa, Artificial Sequence; identical to SEQ ID NO: 29134
  Description of Artificial Sequence: Synthetic polypeptide
  XENP021115 7G8_H0_L0.38_Fab Heavy Chain

SEQ ID NO: 30895 - protein, 121 aa, Artificial Sequence; identical to SEQ ID NO: 17586
  Description of Artificial Sequence: Synthetic polypeptide
  VH of XENP021115

SEQ ID NO: 30896 - protein, 5 aa, Artificial Sequence
  Description of Artificial Sequence: Synthetic peptide
  XENP021115 vhCDR1
DAWMD

SEQ ID NO: 30897 - protein, 19 aa, Artificial Sequence
  Description of Artificial Sequence: Synthetic peptide
  XENP021115 vhCDR2
EIRTKANNHATYYAESVKG

SEQ ID NO: 30898 - protein, 10 aa, Artificial Sequence
  Description of Artificial Sequence: Synthetic peptide
  XENP021115 vhCDR3
LANWDWYFDV

SEQ ID NO: 30899 - protein, 218 aa, Artificial Sequence; identical to SEQ ID NO: 20070
  Description of Artificial Sequence: Synthetic polypeptide
  XENP021115 7G8_H0_L0.38_Fab Light Chain

SEQ ID NO: 30900 - protein, 111 aa, Artificial Sequence; identical to SEQ ID NO: 20071
  Description of Artificial Sequence: Synthetic polypeptide
  VL of XENP021115

SEQ ID NO: 30901 - protein, 15 aa, Artificial Sequence
  Description of Artificial Sequence: Synthetic peptide
  XENP021115 vlCDR1
KASQSVDYDGNSYMN

SEQ ID NO: 30902 - protein, 7 aa, Artificial Sequence
  Description of Artificial Sequence: Synthetic peptide
  XENP021115 vlCDR2
AASNLES

SEQ ID NO: 30903 - protein, 9 aa, Artificial Sequence
  Description of Artificial Sequence: Synthetic peptide
  XENP021115 vlCDR3
QQSNEDPFT

SEQ ID NO: 30904 - protein, 226 aa, Artificial Sequence; identical to SEQ ID NO: 29134
  Description of Artificial Sequence: Synthetic polypeptide
  XENP021116 7G8_H0_L0.39_Fab Heavy Chain

SEQ ID NO: 30905 - protein, 121 aa, Artificial Sequence; identical to SEQ ID NO: 17586
  Description of Artificial Sequence: Synthetic polypeptide
  VH of XENP021116

SEQ ID NO: 30906 - protein, 5 aa, Artificial Sequence
  Description of Artificial Sequence: Synthetic peptide
  XENP021116 vhCDR1
DAWMD

SEQ ID NO: 30907 - protein, 19 aa, Artificial Sequence
  Description of Artificial Sequence: Synthetic peptide
  XENP021116 vhCDR2
EIRTKANNHATYYAESVKG

SEQ ID NO: 30908 - protein, 10 aa, Artificial Sequence
  Description of Artificial Sequence: Synthetic peptide
  XENP021116 vhCDR3
LANWDWYFDV

SEQ ID NO: 30909 - protein, 218 aa, Artificial Sequence; identical to SEQ ID NO: 20080
  Description of Artificial Sequence: Synthetic polypeptide
  XENP021116 7G8_H0_L0.39_Fab Light Chain

SEQ ID NO: 30910 - protein, 111 aa, Artificial Sequence; identical to SEQ ID NO: 20081
  Description of Artificial Sequence: Synthetic polypeptide
  VL of XENP021116

SEQ ID NO: 30911 - protein, 15 aa, Artificial Sequence
  Description of Artificial Sequence: Synthetic peptide
  XENP021116 vlCDR1
KASQSVDYDGESYMN

SEQ ID NO: 30912 - protein, 7 aa, Artificial Sequence
  Description of Artificial Sequence: Synthetic peptide
  XENP021116 vlCDR2
AASNLES

SEQ ID NO: 30913 - protein, 9 aa, Artificial Sequence
  Description of Artificial Sequence: Synthetic peptide
  XENP021116 vlCDR3
QQSNEDPFT

SEQ ID NO: 30914 - protein, 226 aa, Artificial Sequence; identical to SEQ ID NO: 29134
  Description of Artificial Sequence: Synthetic polypeptide
  XENP021117 7G8_H0_L0.40_Fab Heavy Chain

SEQ ID NO: 30915 - protein, 121 aa, Artificial Sequence; identical to SEQ ID NO: 17586
  Description of Artificial Sequence: Synthetic polypeptide
  VH of XENP021117

SEQ ID NO: 30916 - protein, 5 aa, Artificial Sequence
  Description of Artificial Sequence: Synthetic peptide
  XENP021117 vhCDR1
DAWMD

SEQ ID NO: 30917 - protein, 19 aa, Artificial Sequence
  Description of Artificial Sequence: Synthetic peptide
  XENP021117 vhCDR2
EIRTKANNHATYYAESVKG

SEQ ID NO: 30918 - protein, 10 aa, Artificial Sequence
  Description of Artificial Sequence: Synthetic peptide
  XENP021117 vhCDR3
LANWDWYFDV

SEQ ID NO: 30919 - protein, 218 aa, Artificial Sequence; identical to SEQ ID NO: 20090
  Description of Artificial Sequence: Synthetic polypeptide
  XENP021117 7G8_H0_L0.40_Fab Light Chain

SEQ ID NO: 30920 - protein, 111 aa, Artificial Sequence; identical to SEQ ID NO: 20091
  Description of Artificial Sequence: Synthetic polypeptide
  VL of XENP021117

SEQ ID NO: 30921 - protein, 15 aa, Artificial Sequence
  Description of Artificial Sequence: Synthetic peptide
  XENP021117 vlCDR1
KASQSVDYDGHSYMN

SEQ ID NO: 30922 - protein, 7 aa, Artificial Sequence
  Description of Artificial Sequence: Synthetic peptide
  XENP021117 vlCDR2
AASNLES

SEQ ID NO: 30923 - protein, 9 aa, Artificial Sequence
  Description of Artificial Sequence: Synthetic peptide
  XENP021117 vlCDR3
QQSNEDPFT

SEQ ID NO: 30924 - protein, 226 aa, Artificial Sequence; identical to SEQ ID NO: 29134
  Description of Artificial Sequence: Synthetic polypeptide
  XENP021118 7G8_H0_L0.41_Fab Heavy Chain

SEQ ID NO: 30925 - protein, 121 aa, Artificial Sequence; identical to SEQ ID NO: 17586
  Description of Artificial Sequence: Synthetic polypeptide
  VH of XENP021118

SEQ ID NO: 30926 - protein, 5 aa, Artificial Sequence
  Description of Artificial Sequence: Synthetic peptide
  XENP021118 vhCDR1
DAWMD

SEQ ID NO: 30927 - protein, 19 aa, Artificial Sequence
  Description of Artificial Sequence: Synthetic peptide
  XENP021118 vhCDR2
EIRTKANNHATYYAESVKG

SEQ ID NO: 30928 - protein, 10 aa, Artificial Sequence
  Description of Artificial Sequence: Synthetic peptide
  XENP021118 vhCDR3
LANWDWYFDV

SEQ ID NO: 30929 - protein, 218 aa, Artificial Sequence; identical to SEQ ID NO: 20100
  Description of Artificial Sequence: Synthetic polypeptide
  XENP021118 7G8_H0_L0.41_Fab Light Chain

SEQ ID NO: 30930 - protein, 111 aa, Artificial Sequence; identical to SEQ ID NO: 20101
  Description of Artificial Sequence: Synthetic polypeptide
  VL of XENP021118

SEQ ID NO: 30931 - protein, 15 aa, Artificial Sequence
  Description of Artificial Sequence: Synthetic peptide
  XENP021118 vlCDR1
KASQSVDYDGSSYMN

SEQ ID NO: 30932 - protein, 7 aa, Artificial Sequence
  Description of Artificial Sequence: Synthetic peptide
  XENP021118 vlCDR2
AASNLES

SEQ ID NO: 30933 - protein, 9 aa, Artificial Sequence
  Description of Artificial Sequence: Synthetic peptide
  XENP021118 vlCDR3
QQSNEDPFT

SEQ ID NO: 30934 - protein, 226 aa, Artificial Sequence; identical to SEQ ID NO: 29134
  Description of Artificial Sequence: Synthetic polypeptide
  XENP021119 7G8_H0_L0.42_Fab Heavy Chain

SEQ ID NO: 30935 - protein, 121 aa, Artificial Sequence; identical to SEQ ID NO: 17586
  Description of Artificial Sequence: Synthetic polypeptide
  VH of XENP021119

SEQ ID NO: 30936 - protein, 5 aa, Artificial Sequence
  Description of Artificial Sequence: Synthetic peptide
  XENP021119 vhCDR1
DAWMD

SEQ ID NO: 30937 - protein, 19 aa, Artificial Sequence
  Description of Artificial Sequence: Synthetic peptide
  XENP021119 vhCDR2
EIRTKANNHATYYAESVKG

SEQ ID NO: 30938 - protein, 10 aa, Artificial Sequence
  Description of Artificial Sequence: Synthetic peptide
  XENP021119 vhCDR3
LANWDWYFDV

SEQ ID NO: 30939 - protein, 218 aa, Artificial Sequence; identical to SEQ ID NO: 20110
  Description of Artificial Sequence: Synthetic polypeptide
  XENP021119 7G8_H0_L0.42_Fab Light Chain

SEQ ID NO: 30940 - protein, 111 aa, Artificial Sequence; identical to SEQ ID NO: 20111
  Description of Artificial Sequence: Synthetic polypeptide
  VL of XENP021119

SEQ ID NO: 30941 - protein, 15 aa, Artificial Sequence
  Description of Artificial Sequence: Synthetic peptide
  XENP021119 vlCDR1
KASQSVDYDGRSYMN

SEQ ID NO: 30942 - protein, 7 aa, Artificial Sequence
  Description of Artificial Sequence: Synthetic peptide
  XENP021119 vlCDR2
AASNLES

SEQ ID NO: 30943 - protein, 9 aa, Artificial Sequence
  Description of Artificial Sequence: Synthetic peptide
  XENP021119 vlCDR3
QQSNEDPFT

SEQ ID NO: 30944 - protein, 226 aa, Artificial Sequence; identical to SEQ ID NO: 29134
  Description of Artificial Sequence: Synthetic polypeptide
  XENP021120 7G8_H0_L0.43_Fab Heavy Chain

SEQ ID NO: 30945 - protein, 121 aa, Artificial Sequence; identical to SEQ ID NO: 17586
  Description of Artificial Sequence: Synthetic polypeptide
  VH of XENP021120

SEQ ID NO: 30946 - protein, 5 aa, Artificial Sequence
  Description of Artificial Sequence: Synthetic peptide
  XENP021120 vhCDR1
DAWMD

SEQ ID NO: 30947 - protein, 19 aa, Artificial Sequence
  Description of Artificial Sequence: Synthetic peptide
  XENP021120 vhCDR2
EIRTKANNHATYYAESVKG

SEQ ID NO: 30948 - protein, 10 aa, Artificial Sequence
  Description of Artificial Sequence: Synthetic peptide
  XENP021120 vhCDR3
LANWDWYFDV

SEQ ID NO: 30949 - protein, 218 aa, Artificial Sequence; identical to SEQ ID NO: 20120
  Description of Artificial Sequence: Synthetic polypeptide
  XENP021120 7G8_H0_L0.43_Fab Light Chain

SEQ ID NO: 30950 - protein, 111 aa, Artificial Sequence; identical to SEQ ID NO: 20121
  Description of Artificial Sequence: Synthetic polypeptide
  VL of XENP021120

SEQ ID NO: 30951 - protein, 15 aa, Artificial Sequence
  Description of Artificial Sequence: Synthetic peptide
  XENP021120 vlCDR1
KASQSVDYDGLSYMN

SEQ ID NO: 30952 - protein, 7 aa, Artificial Sequence
  Description of Artificial Sequence: Synthetic peptide
  XENP021120 vlCDR2
AASNLES

SEQ ID NO: 30953 - protein, 9 aa, Artificial Sequence
  Description of Artificial Sequence: Synthetic peptide
  XENP021120 vlCDR3
QQSNEDPFT

SEQ ID NO: 30954 - protein, 226 aa, Artificial Sequence; identical to SEQ ID NO: 29134
  Description of Artificial Sequence: Synthetic polypeptide
  XENP021121 7G8_H0_L0.44_Fab Heavy Chain

SEQ ID NO: 30955 - protein, 121 aa, Artificial Sequence; identical to SEQ ID NO: 17586
  Description of Artificial Sequence: Synthetic polypeptide
  VH of XENP021121

SEQ ID NO: 30956 - protein, 5 aa, Artificial Sequence
  Description of Artificial Sequence: Synthetic peptide
  XENP021121 vhCDR1
DAWMD

SEQ ID NO: 30957 - protein, 19 aa, Artificial Sequence
  Description of Artificial Sequence: Synthetic peptide
  XENP021121 vhCDR2
EIRTKANNHATYYAESVKG

SEQ ID NO: 30958 - protein, 10 aa, Artificial Sequence
  Description of Artificial Sequence: Synthetic peptide
  XENP021121 vhCDR3
LANWDWYFDV

SEQ ID NO: 30959 - protein, 218 aa, Artificial Sequence; identical to SEQ ID NO: 20130
  Description of Artificial Sequence: Synthetic polypeptide
  XENP021121 7G8_H0_L0.44_Fab Light Chain

SEQ ID NO: 30960 - protein, 111 aa, Artificial Sequence; identical to SEQ ID NO: 20131
  Description of Artificial Sequence: Synthetic polypeptide
  VL of XENP021121

SEQ ID NO: 30961 - protein, 15 aa, Artificial Sequence
  Description of Artificial Sequence: Synthetic peptide
  XENP021121 vlCDR1
KASQSVDYDGTSYMN

SEQ ID NO: 30962 - protein, 7 aa, Artificial Sequence
  Description of Artificial Sequence: Synthetic peptide
  XENP021121 vlCDR2
AASNLES

SEQ ID NO: 30963 - protein, 9 aa, Artificial Sequence
  Description of Artificial Sequence: Synthetic peptide
  XENP021121 vlCDR3
QQSNEDPFT

SEQ ID NO: 30964 - protein, 226 aa, Artificial Sequence; identical to SEQ ID NO: 29134
  Description of Artificial Sequence: Synthetic polypeptide
  XENP021122 7G8_H0_L0.45_Fab Heavy Chain

SEQ ID NO: 30965 - protein, 121 aa, Artificial Sequence; identical to SEQ ID NO: 17586
  Description of Artificial Sequence: Synthetic polypeptide
  VH of XENP021122

SEQ ID NO: 30966 - protein, 5 aa, Artificial Sequence
  Description of Artificial Sequence: Synthetic peptide
  XENP021122 vhCDR1
DAWMD

SEQ ID NO: 30967 - protein, 19 aa, Artificial Sequence
  Description of Artificial Sequence: Synthetic peptide
  XENP021122 vhCDR2
EIRTKANNHATYYAESVKG

SEQ ID NO: 30968 - protein, 10 aa, Artificial Sequence
  Description of Artificial Sequence: Synthetic peptide
  XENP021122 vhCDR3
LANWDWYFDV

SEQ ID NO: 30969 - protein, 218 aa, Artificial Sequence; identical to SEQ ID NO: 20140
  Description of Artificial Sequence: Synthetic polypeptide
  XENP021122 7G8_H0_L0.45_Fab Light Chain

SEQ ID NO: 30970 - protein, 111 aa, Artificial Sequence; identical to SEQ ID NO: 20141
  Description of Artificial Sequence: Synthetic polypeptide
  VL of XENP021122

SEQ ID NO: 30971 - protein, 15 aa, Artificial Sequence
  Description of Artificial Sequence: Synthetic peptide
  XENP021122 vlCDR1
KASQSVDYDGGSYMN

SEQ ID NO: 30972 - protein, 7 aa, Artificial Sequence
  Description of Artificial Sequence: Synthetic peptide
  XENP021122 vlCDR2
AASNLES

SEQ ID NO: 30973 - protein, 9 aa, Artificial Sequence
  Description of Artificial Sequence: Synthetic peptide
  XENP021122 vlCDR3
QQSNEDPFT

SEQ ID NO: 30974 - protein, 226 aa, Artificial Sequence; identical to SEQ ID NO: 29134
  Description of Artificial Sequence: Synthetic polypeptide
  XENP021123 7G8_H0_L0.46_Fab Heavy Chain

SEQ ID NO: 30975 - protein, 121 aa, Artificial Sequence; identical to SEQ ID NO: 17586
  Description of Artificial Sequence: Synthetic polypeptide
  VH of XENP021123

SEQ ID NO: 30976 - protein, 5 aa, Artificial Sequence
  Description of Artificial Sequence: Synthetic peptide
  XENP021123 vhCDR1
DAWMD

SEQ ID NO: 30977 - protein, 19 aa, Artificial Sequence
  Description of Artificial Sequence: Synthetic peptide
  XENP021123 vhCDR2
EIRTKANNHATYYAESVKG

SEQ ID NO: 30978 - protein, 10 aa, Artificial Sequence
  Description of Artificial Sequence: Synthetic peptide
  XENP021123 vhCDR3
LANWDWYFDV

SEQ ID NO: 30979 - protein, 218 aa, Artificial Sequence; identical to SEQ ID NO: 20150
  Description of Artificial Sequence: Synthetic polypeptide
  XENP021123 7G8_H0_L0.46_Fab Light Chain

SEQ ID NO: 30980 - protein, 111 aa, Artificial Sequence; identical to SEQ ID NO: 20151
  Description of Artificial Sequence: Synthetic polypeptide
  VL of XENP021123

SEQ ID NO: 30981 - protein, 15 aa, Artificial Sequence
  Description of Artificial Sequence: Synthetic peptide
  XENP021123 vlCDR1
KASQSVDYDGYSYMN

SEQ ID NO: 30982 - protein, 7 aa, Artificial Sequence
  Description of Artificial Sequence: Synthetic peptide
  XENP021123 vlCDR2
AASNLES

SEQ ID NO: 30983 - protein, 9 aa, Artificial Sequence
  Description of Artificial Sequence: Synthetic peptide
  XENP021123 vlCDR3
QQSNEDPFT

SEQ ID NO: 30984 - protein, 226 aa, Artificial Sequence; identical to SEQ ID NO: 29134
  Description of Artificial Sequence: Synthetic polypeptide
  XENP021124 7G8_H0_L0.47_Fab Heavy Chain

SEQ ID NO: 30985 - protein, 121 aa, Artificial Sequence; identical to SEQ ID NO: 17586
  Description of Artificial Sequence: Synthetic polypeptide
  VH of XENP021124

SEQ ID NO: 30986 - protein, 5 aa, Artificial Sequence
  Description of Artificial Sequence: Synthetic peptide
  XENP021124 vhCDR1
DAWMD

SEQ ID NO: 30987 - protein, 19 aa, Artificial Sequence
  Description of Artificial Sequence: Synthetic peptide
  XENP021124 vhCDR2
EIRTKANNHATYYAESVKG

SEQ ID NO: 30988 - protein, 10 aa, Artificial Sequence
  Description of Artificial Sequence: Synthetic peptide
  XENP021124 vhCDR3
LANWDWYFDV

SEQ ID NO: 30989 - protein, 218 aa, Artificial Sequence; identical to SEQ ID NO: 20160
  Description of Artificial Sequence: Synthetic polypeptide
  XENP021124 7G8_H0_L0.47_Fab Light Chain

SEQ ID NO: 30990 - protein, 111 aa, Artificial Sequence; identical to SEQ ID NO: 20161
  Description of Artificial Sequence: Synthetic polypeptide
  VL of XENP021124

SEQ ID NO: 30991 - protein, 15 aa, Artificial Sequence
  Description of Artificial Sequence: Synthetic peptide
  XENP021124 vlCDR1
KASQSVDYDGDSYMN

SEQ ID NO: 30992 - protein, 7 aa, Artificial Sequence
  Description of Artificial Sequence: Synthetic peptide
  XENP021124 vlCDR2
AASNLES

SEQ ID NO: 30993 - protein, 9 aa, Artificial Sequence
  Description of Artificial Sequence: Synthetic peptide
  XENP021124 vlCDR3
QQSNEDPFT

SEQ ID NO: 30994 - protein, 226 aa, Artificial Sequence; identical to SEQ ID NO: 29134
  Description of Artificial Sequence: Synthetic polypeptide
  XENP021125 7G8_H0_L0.48_Fab Heavy Chain

SEQ ID NO: 30995 - protein, 121 aa, Artificial Sequence; identical to SEQ ID NO: 17586
  Description of Artificial Sequence: Synthetic polypeptide
  VH of XENP021125

SEQ ID NO: 30996 - protein, 5 aa, Artificial Sequence
  Description of Artificial Sequence: Synthetic peptide
  XENP021125 vhCDR1
DAWMD

SEQ ID NO: 30997 - protein, 19 aa, Artificial Sequence
  Description of Artificial Sequence: Synthetic peptide
  XENP021125 vhCDR2
EIRTKANNHATYYAESVKG

SEQ ID NO: 30998 - protein, 10 aa, Artificial Sequence
  Description of Artificial Sequence: Synthetic peptide
  XENP021125 vhCDR3
LANWDWYFDV

SEQ ID NO: 30999 - protein, 218 aa, Artificial Sequence; identical to SEQ ID NO: 20170
  Description of Artificial Sequence: Synthetic polypeptide
  XENP021125 7G8_H0_L0.48_Fab Light Chain

SEQ ID NO: 31000 - protein, 111 aa, Artificial Sequence; identical to SEQ ID NO: 20171
  Description of Artificial Sequence: Synthetic polypeptide
  VL of XENP021125

SEQ ID NO: 31001 - protein, 15 aa, Artificial Sequence
  Description of Artificial Sequence: Synthetic peptide
  XENP021125 vlCDR1
KASQSVDYDGDSYMN

SEQ ID NO: 31002 - protein, 7 aa, Artificial Sequence
  Description of Artificial Sequence: Synthetic peptide
  XENP021125 vlCDR2
SASNLES

SEQ ID NO: 31003 - protein, 9 aa, Artificial Sequence
  Description of Artificial Sequence: Synthetic peptide
  XENP021125 vlCDR3
QQSNEDPFT

SEQ ID NO: 31004 - protein, 226 aa, Artificial Sequence; identical to SEQ ID NO: 29134
  Description of Artificial Sequence: Synthetic polypeptide
  XENP021126 7G8_H0_L0.49_Fab Heavy Chain

SEQ ID NO: 31005 - protein, 121 aa, Artificial Sequence; identical to SEQ ID NO: 17586
  Description of Artificial Sequence: Synthetic polypeptide
  VH of XENP021126

SEQ ID NO: 31006 - protein, 5 aa, Artificial Sequence
  Description of Artificial Sequence: Synthetic peptide
  XENP021126 vhCDR1
DAWMD

SEQ ID NO: 31007 - protein, 19 aa, Artificial Sequence
  Description of Artificial Sequence: Synthetic peptide
  XENP021126 vhCDR2
EIRTKANNHATYYAESVKG

SEQ ID NO: 31008 - protein, 10 aa, Artificial Sequence
  Description of Artificial Sequence: Synthetic peptide
  XENP021126 vhCDR3
LANWDWYFDV

SEQ ID NO: 31009 - protein, 218 aa, Artificial Sequence; identical to SEQ ID NO: 20180
  Description of Artificial Sequence: Synthetic polypeptide
  XENP021126 7G8_H0_L0.49_Fab Light Chain

SEQ ID NO: 31010 - protein, 111 aa, Artificial Sequence; identical to SEQ ID NO: 20181
  Description of Artificial Sequence: Synthetic polypeptide
  VL of XENP021126

SEQ ID NO: 31011 - protein, 15 aa, Artificial Sequence
  Description of Artificial Sequence: Synthetic peptide
  XENP021126 vlCDR1
KASQSVDYDGDSYMN

SEQ ID NO: 31012 - protein, 7 aa, Artificial Sequence
  Description of Artificial Sequence: Synthetic peptide
  XENP021126 vlCDR2
TASNLES

SEQ ID NO: 31013 - protein, 9 aa, Artificial Sequence
  Description of Artificial Sequence: Synthetic peptide
  XENP021126 vlCDR3
QQSNEDPFT

SEQ ID NO: 31014 - protein, 226 aa, Artificial Sequence; identical to SEQ ID NO: 29134
  Description of Artificial Sequence: Synthetic polypeptide
  XENP021127 7G8_H0_L0.50_Fab Heavy Chain

SEQ ID NO: 31015 - protein, 121 aa, Artificial Sequence; identical to SEQ ID NO: 17586
  Description of Artificial Sequence: Synthetic polypeptide
  VH of XENP021127

SEQ ID NO: 31016 - protein, 5 aa, Artificial Sequence
  Description of Artificial Sequence: Synthetic peptide
  XENP021127 vhCDR1
DAWMD

SEQ ID NO: 31017 - protein, 19 aa, Artificial Sequence
  Description of Artificial Sequence: Synthetic peptide
  XENP021127 vhCDR2
EIRTKANNHATYYAESVKG

SEQ ID NO: 31018 - protein, 10 aa, Artificial Sequence
  Description of Artificial Sequence: Synthetic peptide
  XENP021127 vhCDR3
LANWDWYFDV

SEQ ID NO: 31019 - protein, 218 aa, Artificial Sequence; identical to SEQ ID NO: 20190
  Description of Artificial Sequence: Synthetic polypeptide
  XENP021127 7G8_H0_L0.50_Fab Light Chain

SEQ ID NO: 31020 - protein, 111 aa, Artificial Sequence; identical to SEQ ID NO: 20191
  Description of Artificial Sequence: Synthetic polypeptide
  VL of XENP021127

SEQ ID NO: 31021 - protein, 15 aa, Artificial Sequence
  Description of Artificial Sequence: Synthetic peptide
  XENP021127 vlCDR1
KASQSVDYDGDSYMN

SEQ ID NO: 31022 - protein, 7 aa, Artificial Sequence
  Description of Artificial Sequence: Synthetic peptide
  XENP021127 vlCDR2
GASNLES

SEQ ID NO: 31023 - protein, 9 aa, Artificial Sequence
  Description of Artificial Sequence: Synthetic peptide
  XENP021127 vlCDR3
QQSNEDPFT

SEQ ID NO: 31024 - protein, 226 aa, Artificial Sequence; identical to SEQ ID NO: 29134
  Description of Artificial Sequence: Synthetic polypeptide
  XENP021128 7G8_H0_L0.51_Fab Heavy Chain

SEQ ID NO: 31025 - protein, 121 aa, Artificial Sequence; identical to SEQ ID NO: 17586
  Description of Artificial Sequence: Synthetic polypeptide
  VH of XENP021128

SEQ ID NO: 31026 - protein, 5 aa, Artificial Sequence
  Description of Artificial Sequence: Synthetic peptide
  XENP021128 vhCDR1
DAWMD

SEQ ID NO: 31027 - protein, 19 aa, Artificial Sequence
  Description of Artificial Sequence: Synthetic peptide
  XENP021128 vhCDR2
EIRTKANNHATYYAESVKG

SEQ ID NO: 31028 - protein, 10 aa, Artificial Sequence
  Description of Artificial Sequence: Synthetic peptide
  XENP021128 vhCDR3
LANWDWYFDV

SEQ ID NO: 31029 - protein, 218 aa, Artificial Sequence; identical to SEQ ID NO: 20200
  Description of Artificial Sequence: Synthetic polypeptide
  XENP021128 7G8_H0_L0.51_Fab Light Chain

SEQ ID NO: 31030 - protein, 111 aa, Artificial Sequence; identical to SEQ ID NO: 20201
  Description of Artificial Sequence: Synthetic polypeptide
  VL of XENP021128

SEQ ID NO: 31031 - protein, 15 aa, Artificial Sequence
  Description of Artificial Sequence: Synthetic peptide
  XENP021128 vlCDR1
KASQSVDYDGDSYMN

SEQ ID NO: 31032 - protein, 7 aa, Artificial Sequence
  Description of Artificial Sequence: Synthetic peptide
  XENP021128 vlCDR2
HASNLES

SEQ ID NO: 31033 - protein, 9 aa, Artificial Sequence
  Description of Artificial Sequence: Synthetic peptide
  XENP021128 vlCDR3
QQSNEDPFT

SEQ ID NO: 31034 - protein, 226 aa, Artificial Sequence; identical to SEQ ID NO: 29134
  Description of Artificial Sequence: Synthetic polypeptide
  XENP021129 7G8_H0_L0.52_Fab Heavy Chain

SEQ ID NO: 31035 - protein, 121 aa, Artificial Sequence; identical to SEQ ID NO: 17586
  Description of Artificial Sequence: Synthetic polypeptide
  VH of XENP021129

SEQ ID NO: 31036 - protein, 5 aa, Artificial Sequence
  Description of Artificial Sequence: Synthetic peptide
  XENP021129 vhCDR1
DAWMD

SEQ ID NO: 31037 - protein, 19 aa, Artificial Sequence
  Description of Artificial Sequence: Synthetic peptide
  XENP021129 vhCDR2
EIRTKANNHATYYAESVKG

SEQ ID NO: 31038 - protein, 10 aa, Artificial Sequence
  Description of Artificial Sequence: Synthetic peptide
  XENP021129 vhCDR3
LANWDWYFDV

SEQ ID NO: 31039 - protein, 218 aa, Artificial Sequence; identical to SEQ ID NO: 20210
  Description of Artificial Sequence: Synthetic polypeptide
  XENP021129 7G8_H0_L0.52_Fab Light Chain

SEQ ID NO: 31040 - protein, 111 aa, Artificial Sequence; identical to SEQ ID NO: 20211
  Description of Artificial Sequence: Synthetic polypeptide
  VL of XENP021129

SEQ ID NO: 31041 - protein, 15 aa, Artificial Sequence
  Description of Artificial Sequence: Synthetic peptide
  XENP021129 vlCDR1
KASQSVDYDGDSYMN

SEQ ID NO: 31042 - protein, 7 aa, Artificial Sequence
  Description of Artificial Sequence: Synthetic peptide
  XENP021129 vlCDR2
QASNLES

SEQ ID NO: 31043 - protein, 9 aa, Artificial Sequence
  Description of Artificial Sequence: Synthetic peptide
  XENP021129 vlCDR3
QQSNEDPFT

SEQ ID NO: 31044 - protein, 226 aa, Artificial Sequence; identical to SEQ ID NO: 29134
  Description of Artificial Sequence: Synthetic polypeptide
  XENP021130 7G8_H0_L0.53_Fab Heavy Chain

SEQ ID NO: 31045 - protein, 121 aa, Artificial Sequence; identical to SEQ ID NO: 17586
  Description of Artificial Sequence: Synthetic polypeptide
  VH of XENP021130

SEQ ID NO: 31046 - protein, 5 aa, Artificial Sequence
  Description of Artificial Sequence: Synthetic peptide
  XENP021130 vhCDR1
DAWMD

SEQ ID NO: 31047 - protein, 19 aa, Artificial Sequence
  Description of Artificial Sequence: Synthetic peptide
  XENP021130 vhCDR2
EIRTKANNHATYYAESVKG

SEQ ID NO: 31048 - protein, 10 aa, Artificial Sequence
  Description of Artificial Sequence: Synthetic peptide
  XENP021130 vhCDR3
LANWDWYFDV

SEQ ID NO: 31049 - protein, 218 aa, Artificial Sequence; identical to SEQ ID NO: 20220
  Description of Artificial Sequence: Synthetic polypeptide
  XENP021130 7G8_H0_L0.53_Fab Light Chain

SEQ ID NO: 31050 - protein, 111 aa, Artificial Sequence; identical to SEQ ID NO: 20221
  Description of Artificial Sequence: Synthetic polypeptide
  VL of XENP021130

SEQ ID NO: 31051 - protein, 15 aa, Artificial Sequence
  Description of Artificial Sequence: Synthetic peptide
  XENP021130 vlCDR1
KASQSVDYDGDSYMN

SEQ ID NO: 31052 - protein, 7 aa, Artificial Sequence
  Description of Artificial Sequence: Synthetic peptide
  XENP021130 vlCDR2
DASNLES

SEQ ID NO: 31053 - protein, 9 aa, Artificial Sequence
  Description of Artificial Sequence: Synthetic peptide
  XENP021130 vlCDR3
QQSNEDPFT

SEQ ID NO: 31054 - protein, 226 aa, Artificial Sequence; identical to SEQ ID NO: 29134
  Description of Artificial Sequence: Synthetic polypeptide
  XENP021131 7G8_H0_L0.54_Fab Heavy Chain

SEQ ID NO: 31055 - protein, 121 aa, Artificial Sequence; identical to SEQ ID NO: 17586
  Description of Artificial Sequence: Synthetic polypeptide
  VH of XENP021131

SEQ ID NO: 31056 - protein, 5 aa, Artificial Sequence
  Description of Artificial Sequence: Synthetic peptide
  XENP021131 vhCDR1
DAWMD

SEQ ID NO: 31057 - protein, 19 aa, Artificial Sequence
  Description of Artificial Sequence: Synthetic peptide
  XENP021131 vhCDR2
EIRTKANNHATYYAESVKG

SEQ ID NO: 31058 - protein, 10 aa, Artificial Sequence
  Description of Artificial Sequence: Synthetic peptide
  XENP021131 vhCDR3
LANWDWYFDV

SEQ ID NO: 31059 - protein, 218 aa, Artificial Sequence; identical to SEQ ID NO: 20230
  Description of Artificial Sequence: Synthetic polypeptide
  XENP021131 7G8_H0_L0.54_Fab Light Chain

SEQ ID NO: 31060 - protein, 111 aa, Artificial Sequence; identical to SEQ ID NO: 20231
  Description of Artificial Sequence: Synthetic polypeptide
  VL of XENP021131

SEQ ID NO: 31061 - protein, 15 aa, Artificial Sequence
  Description of Artificial Sequence: Synthetic peptide
  XENP021131 vlCDR1
KASQSVDYDGDSYMN

SEQ ID NO: 31062 - protein, 7 aa, Artificial Sequence
  Description of Artificial Sequence: Synthetic peptide
  XENP021131 vlCDR2
LASNLES

SEQ ID NO: 31063 - protein, 9 aa, Artificial Sequence
  Description of Artificial Sequence: Synthetic peptide
  XENP021131 vlCDR3
QQSNEDPFT

SEQ ID NO: 31064 - protein, 226 aa, Artificial Sequence; identical to SEQ ID NO: 29134
  Description of Artificial Sequence: Synthetic polypeptide
  XENP021132 7G8_H0_L0.55_Fab Heavy Chain

SEQ ID NO: 31065 - protein, 121 aa, Artificial Sequence; identical to SEQ ID NO: 17586
  Description of Artificial Sequence: Synthetic polypeptide
  VH of XENP021132

SEQ ID NO: 31066 - protein, 5 aa, Artificial Sequence
  Description of Artificial Sequence: Synthetic peptide
  XENP021132 vhCDR1
DAWMD

SEQ ID NO: 31067 - protein, 19 aa, Artificial Sequence
  Description of Artificial Sequence: Synthetic peptide
  XENP021132 vhCDR2
EIRTKANNHATYYAESVKG

SEQ ID NO: 31068 - protein, 10 aa, Artificial Sequence
  Description of Artificial Sequence: Synthetic peptide
  XENP021132 vhCDR3
LANWDWYFDV

SEQ ID NO: 31069 - protein, 218 aa, Artificial Sequence; identical to SEQ ID NO: 20240
  Description of Artificial Sequence: Synthetic polypeptide
  XENP021132 7G8_H0_L0.55_Fab Light Chain

SEQ ID NO: 31070 - protein, 111 aa, Artificial Sequence; identical to SEQ ID NO: 20241
  Description of Artificial Sequence: Synthetic polypeptide
  VL of XENP021132

SEQ ID NO: 31071 - protein, 15 aa, Artificial Sequence
  Description of Artificial Sequence: Synthetic peptide
  XENP021132 vlCDR1
KASQSVDYDGDSYMN

SEQ ID NO: 31072 - protein, 7 aa, Artificial Sequence
  Description of Artificial Sequence: Synthetic peptide
  XENP021132 vlCDR2
KASNLES

SEQ ID NO: 31073 - protein, 9 aa, Artificial Sequence
  Description of Artificial Sequence: Synthetic peptide
  XENP021132 vlCDR3
QQSNEDPFT

SEQ ID NO: 31074 - protein, 226 aa, Artificial Sequence; identical to SEQ ID NO: 29134
  Description of Artificial Sequence: Synthetic polypeptide
  XENP021133 7G8_H0_L0.56_Fab Heavy Chain

SEQ ID NO: 31075 - protein, 121 aa, Artificial Sequence; identical to SEQ ID NO: 17586
  Description of Artificial Sequence: Synthetic polypeptide
  VH of XENP021133

SEQ ID NO: 31076 - protein, 5 aa, Artificial Sequence
  Description of Artificial Sequence: Synthetic peptide
  XENP021133 vhCDR1
DAWMD

SEQ ID NO: 31077 - protein, 19 aa, Artificial Sequence
  Description of Artificial Sequence: Synthetic peptide
  XENP021133 vhCDR2
EIRTKANNHATYYAESVKG

SEQ ID NO: 31078 - protein, 10 aa, Artificial Sequence
  Description of Artificial Sequence: Synthetic peptide
  XENP021133 vhCDR3
LANWDWYFDV

SEQ ID NO: 31079 - protein, 218 aa, Artificial Sequence; identical to SEQ ID NO: 20250
  Description of Artificial Sequence: Synthetic polypeptide
  XENP021133 7G8_H0_L0.56_Fab Light Chain

SEQ ID NO: 31080 - protein, 111 aa, Artificial Sequence; identical to SEQ ID NO: 20251
  Description of Artificial Sequence: Synthetic polypeptide
  VL of XENP021133

SEQ ID NO: 31081 - protein, 15 aa, Artificial Sequence
  Description of Artificial Sequence: Synthetic peptide
  XENP021133 vlCDR1
KASQSVDYDGDSYMN

SEQ ID NO: 31082 - protein, 7 aa, Artificial Sequence
  Description of Artificial Sequence: Synthetic peptide
  XENP021133 vlCDR2
YASNLES

SEQ ID NO: 31083 - protein, 9 aa, Artificial Sequence
  Description of Artificial Sequence: Synthetic peptide
  XENP021133 vlCDR3
QQSNEDPFT

SEQ ID NO: 31084 - protein, 226 aa, Artificial Sequence; identical to SEQ ID NO: 29134
  Description of Artificial Sequence: Synthetic polypeptide
  XENP021134 7G8_H0_L0.57_Fab Heavy Chain

SEQ ID NO: 31085 - protein, 121 aa, Artificial Sequence; identical to SEQ ID NO: 17586
  Description of Artificial Sequence: Synthetic polypeptide
  VH of XENP021134

SEQ ID NO: 31086 - protein, 5 aa, Artificial Sequence
  Description of Artificial Sequence: Synthetic peptide
  XENP021134 vhCDR1
DAWMD

SEQ ID NO: 31087 - protein, 19 aa, Artificial Sequence
  Description of Artificial Sequence: Synthetic peptide
  XENP021134 vhCDR2
EIRTKANNHATYYAESVKG

SEQ ID NO: 31088 - protein, 10 aa, Artificial Sequence
  Description of Artificial Sequence: Synthetic peptide
  XENP021134 vhCDR3
LANWDWYFDV

SEQ ID NO: 31089 - protein, 218 aa, Artificial Sequence; identical to SEQ ID NO: 20260
  Description of Artificial Sequence: Synthetic polypeptide
  XENP021134 7G8_H0_L0.57_Fab Light Chain

SEQ ID NO: 31090 - protein, 111 aa, Artificial Sequence; identical to SEQ ID NO: 20261
  Description of Artificial Sequence: Synthetic polypeptide
  VL of XENP021134

SEQ ID NO: 31091 - protein, 15 aa, Artificial Sequence
  Description of Artificial Sequence: Synthetic peptide
  XENP021134 vlCDR1
KASQSVDYDGDSYMN

SEQ ID NO: 31092 - protein, 7 aa, Artificial Sequence
  Description of Artificial Sequence: Synthetic peptide
  XENP021134 vlCDR2
AASDLES

SEQ ID NO: 31093 - protein, 9 aa, Artificial Sequence
  Description of Artificial Sequence: Synthetic peptide
  XENP021134 vlCDR3
QQSNEDPFT

SEQ ID NO: 31094 - protein, 226 aa, Artificial Sequence; identical to SEQ ID NO: 29134
  Description of Artificial Sequence: Synthetic polypeptide
  XENP021135 7G8_H0_L0.58_Fab Heavy Chain

SEQ ID NO: 31095 - protein, 121 aa, Artificial Sequence; identical to SEQ ID NO: 17586
  Description of Artificial Sequence: Synthetic polypeptide
  VH of XENP021135

SEQ ID NO: 31096 - protein, 5 aa, Artificial Sequence
  Description of Artificial Sequence: Synthetic peptide
  XENP021135 vhCDR1
DAWMD

SEQ ID NO: 31097 - protein, 19 aa, Artificial Sequence
  Description of Artificial Sequence: Synthetic peptide
  XENP021135 vhCDR2
EIRTKANNHATYYAESVKG

SEQ ID NO: 31098 - protein, 10 aa, Artificial Sequence
  Description of Artificial Sequence: Synthetic peptide
  XENP021135 vhCDR3
LANWDWYFDV

SEQ ID NO: 31099 - protein, 218 aa, Artificial Sequence; identical to SEQ ID NO: 20270
  Description of Artificial Sequence: Synthetic polypeptide
  XENP021135 7G8_H0_L0.58_Fab Light Chain

SEQ ID NO: 31100 - protein, 111 aa, Artificial Sequence; identical to SEQ ID NO: 20271
  Description of Artificial Sequence: Synthetic polypeptide
  VL of XENP021135

SEQ ID NO: 31101 - protein, 15 aa, Artificial Sequence
  Description of Artificial Sequence: Synthetic peptide
  XENP021135 vlCDR1
KASQSVDYDGDSYMN

SEQ ID NO: 31102 - protein, 7 aa, Artificial Sequence
  Description of Artificial Sequence: Synthetic peptide
  XENP021135 vlCDR2
AASHLES

SEQ ID NO: 31103 - protein, 9 aa, Artificial Sequence
  Description of Artificial Sequence: Synthetic peptide
  XENP021135 vlCDR3
QQSNEDPFT

SEQ ID NO: 31104 - protein, 226 aa, Artificial Sequence; identical to SEQ ID NO: 29134
  Description of Artificial Sequence: Synthetic polypeptide
  XENP021136 7G8_H0_L0.59_Fab Heavy Chain

SEQ ID NO: 31105 - protein, 121 aa, Artificial Sequence; identical to SEQ ID NO: 17586
  Description of Artificial Sequence: Synthetic polypeptide
  VH of XENP021136

SEQ ID NO: 31106 - protein, 5 aa, Artificial Sequence
  Description of Artificial Sequence: Synthetic peptide
  XENP021136 vhCDR1
DAWMD

SEQ ID NO: 31107 - protein, 19 aa, Artificial Sequence
  Description of Artificial Sequence: Synthetic peptide
  XENP021136 vhCDR2
EIRTKANNHATYYAESVKG

SEQ ID NO: 31108 - protein, 10 aa, Artificial Sequence
  Description of Artificial Sequence: Synthetic peptide
  XENP021136 vhCDR3
LANWDWYFDV

SEQ ID NO: 31109 - protein, 218 aa, Artificial Sequence; identical to SEQ ID NO: 20280
  Description of Artificial Sequence: Synthetic polypeptide
  XENP021136 7G8_H0_L0.59_Fab Light Chain

SEQ ID NO: 31110 - protein, 111 aa, Artificial Sequence; identical to SEQ ID NO: 20281
  Description of Artificial Sequence: Synthetic polypeptide
  VL of XENP021136

SEQ ID NO: 31111 - protein, 15 aa, Artificial Sequence
  Description of Artificial Sequence: Synthetic peptide
  XENP021136 vlCDR1
KASQSVDYDGDSYMN

SEQ ID NO: 31112 - protein, 7 aa, Artificial Sequence
  Description of Artificial Sequence: Synthetic peptide
  XENP021136 vlCDR2
AASELES

SEQ ID NO: 31113 - protein, 9 aa, Artificial Sequence
  Description of Artificial Sequence: Synthetic peptide
  XENP021136 vlCDR3
QQSNEDPFT

SEQ ID NO: 31114 - protein, 226 aa, Artificial Sequence; identical to SEQ ID NO: 29134
  Description of Artificial Sequence: Synthetic polypeptide
  XENP021137 7G8_H0_L0.60_Fab Heavy Chain

SEQ ID NO: 31115 - protein, 121 aa, Artificial Sequence; identical to SEQ ID NO: 17586
  Description of Artificial Sequence: Synthetic polypeptide
  VH of XENP021137

SEQ ID NO: 31116 - protein, 5 aa, Artificial Sequence
  Description of Artificial Sequence: Synthetic peptide
  XENP021137 vhCDR1
DAWMD

SEQ ID NO: 31117 - protein, 19 aa, Artificial Sequence
  Description of Artificial Sequence: Synthetic peptide
  XENP021137 vhCDR2
EIRTKANNHATYYAESVKG

SEQ ID NO: 31118 - protein, 10 aa, Artificial Sequence
  Description of Artificial Sequence: Synthetic peptide
  XENP021137 vhCDR3
LANWDWYFDV

SEQ ID NO: 31119 - protein, 218 aa, Artificial Sequence; identical to SEQ ID NO: 20290
  Description of Artificial Sequence: Synthetic polypeptide
  XENP021137 7G8_H0_L0.60_Fab Light Chain

SEQ ID NO: 31120 - protein, 111 aa, Artificial Sequence; identical to SEQ ID NO: 20291
  Description of Artificial Sequence: Synthetic polypeptide
  VL of XENP021137

SEQ ID NO: 31121 - protein, 15 aa, Artificial Sequence
  Description of Artificial Sequence: Synthetic peptide
  XENP021137 vlCDR1
KASQSVDYDGDSYMN

SEQ ID NO: 31122 - protein, 7 aa, Artificial Sequence
  Description of Artificial Sequence: Synthetic peptide
  XENP021137 vlCDR2
AASSLES

SEQ ID NO: 31123 - protein, 9 aa, Artificial Sequence
  Description of Artificial Sequence: Synthetic peptide
  XENP021137 vlCDR3
QQSNEDPFT

SEQ ID NO: 31124 - protein, 226 aa, Artificial Sequence; identical to SEQ ID NO: 29134
  Description of Artificial Sequence: Synthetic polypeptide
  XENP021138 7G8_H0_L0.61_Fab Heavy Chain

SEQ ID NO: 31125 - protein, 121 aa, Artificial Sequence; identical to SEQ ID NO: 17586
  Description of Artificial Sequence: Synthetic polypeptide
  VH of XENP021138

SEQ ID NO: 31126 - protein, 5 aa, Artificial Sequence
  Description of Artificial Sequence: Synthetic peptide
  XENP021138 vhCDR1
DAWMD

SEQ ID NO: 31127 - protein, 19 aa, Artificial Sequence
  Description of Artificial Sequence: Synthetic peptide
  XENP021138 vhCDR2
EIRTKANNHATYYAESVKG

SEQ ID NO: 31128 - protein, 10 aa, Artificial Sequence
  Description of Artificial Sequence: Synthetic peptide
  XENP021138 vhCDR3
LANWDWYFDV

SEQ ID NO: 31129 - protein, 218 aa, Artificial Sequence; identical to SEQ ID NO: 20300
  Description of Artificial Sequence: Synthetic polypeptide
  XENP021138 7G8_H0_L0.61_Fab Light Chain

SEQ ID NO: 31130 - protein, 111 aa, Artificial Sequence; identical to SEQ ID NO: 20301
  Description of Artificial Sequence: Synthetic polypeptide
  VL of XENP021138

SEQ ID NO: 31131 - protein, 15 aa, Artificial Sequence
  Description of Artificial Sequence: Synthetic peptide
  XENP021138 vlCDR1
KASQSVDYDGDSYMN

SEQ ID NO: 31132 - protein, 7 aa, Artificial Sequence
  Description of Artificial Sequence: Synthetic peptide
  XENP021138 vlCDR2
AASRLES

SEQ ID NO: 31133 - protein, 9 aa, Artificial Sequence
  Description of Artificial Sequence: Synthetic peptide
  XENP021138 vlCDR3
QQSNEDPFT

SEQ ID NO: 31134 - protein, 226 aa, Artificial Sequence; identical to SEQ ID NO: 29134
  Description of Artificial Sequence: Synthetic polypeptide
  XENP021139 7G8_H0_L0.62_Fab Heavy Chain

SEQ ID NO: 31135 - protein, 121 aa, Artificial Sequence; identical to SEQ ID NO: 17586
  Description of Artificial Sequence: Synthetic polypeptide
  VH of XENP021139

SEQ ID NO: 31136 - protein, 5 aa, Artificial Sequence
  Description of Artificial Sequence: Synthetic peptide
  XENP021139 vhCDR1
DAWMD

SEQ ID NO: 31137 - protein, 19 aa, Artificial Sequence
  Description of Artificial Sequence: Synthetic peptide
  XENP021139 vhCDR2
EIRTKANNHATYYAESVKG

SEQ ID NO: 31138 - protein, 10 aa, Artificial Sequence
  Description of Artificial Sequence: Synthetic peptide
  XENP021139 vhCDR3
LANWDWYFDV

SEQ ID NO: 31139 - protein, 218 aa, Artificial Sequence; identical to SEQ ID NO: 20310
  Description of Artificial Sequence: Synthetic polypeptide
  XENP021139 7G8_H0_L0.62_Fab Light Chain

SEQ ID NO: 31140 - protein, 111 aa, Artificial Sequence; identical to SEQ ID NO: 20311
  Description of Artificial Sequence: Synthetic polypeptide
  VL of XENP021139

SEQ ID NO: 31141 - protein, 15 aa, Artificial Sequence
  Description of Artificial Sequence: Synthetic peptide
  XENP021139 vlCDR1
KASQSVDYDGDSYMN

SEQ ID NO: 31142 - protein, 7 aa, Artificial Sequence
  Description of Artificial Sequence: Synthetic peptide
  XENP021139 vlCDR2
AASLLES

SEQ ID NO: 31143 - protein, 9 aa, Artificial Sequence
  Description of Artificial Sequence: Synthetic peptide
  XENP021139 vlCDR3
QQSNEDPFT

SEQ ID NO: 31144 - protein, 226 aa, Artificial Sequence; identical to SEQ ID NO: 29134
  Description of Artificial Sequence: Synthetic polypeptide
  XENP021140 7G8_H0_L0.63_Fab Heavy Chain

SEQ ID NO: 31145 - protein, 121 aa, Artificial Sequence; identical to SEQ ID NO: 17586
  Description of Artificial Sequence: Synthetic polypeptide
  VH of XENP021140

SEQ ID NO: 31146 - protein, 5 aa, Artificial Sequence
  Description of Artificial Sequence: Synthetic peptide
  XENP021140 vhCDR1
DAWMD

SEQ ID NO: 31147 - protein, 19 aa, Artificial Sequence
  Description of Artificial Sequence: Synthetic peptide
  XENP021140 vhCDR2
EIRTKANNHATYYAESVKG

SEQ ID NO: 31148 - protein, 10 aa, Artificial Sequence
  Description of Artificial Sequence: Synthetic peptide
  XENP021140 vhCDR3
LANWDWYFDV

SEQ ID NO: 31149 - protein, 218 aa, Artificial Sequence; identical to SEQ ID NO: 20320
  Description of Artificial Sequence: Synthetic polypeptide
  XENP021140 7G8_H0_L0.63_Fab Light Chain

SEQ ID NO: 31150 - protein, 111 aa, Artificial Sequence; identical to SEQ ID NO: 20321
  Description of Artificial Sequence: Synthetic polypeptide
  VL of XENP021140

SEQ ID NO: 31151 - protein, 15 aa, Artificial Sequence
  Description of Artificial Sequence: Synthetic peptide
  XENP021140 vlCDR1
KASQSVDYDGDSYMN

SEQ ID NO: 31152 - protein, 7 aa, Artificial Sequence
  Description of Artificial Sequence: Synthetic peptide
  XENP021140 vlCDR2
AASTLES

SEQ ID NO: 31153 - protein, 9 aa, Artificial Sequence
  Description of Artificial Sequence: Synthetic peptide
  XENP021140 vlCDR3
QQSNEDPFT

SEQ ID NO: 31154 - protein, 226 aa, Artificial Sequence; identical to SEQ ID NO: 29134
  Description of Artificial Sequence: Synthetic polypeptide
  XENP021141 7G8_H0_L0.64_Fab Heavy Chain

SEQ ID NO: 31155 - protein, 121 aa, Artificial Sequence; identical to SEQ ID NO: 17586
  Description of Artificial Sequence: Synthetic polypeptide
  VH of XENP021141

SEQ ID NO: 31156 - protein, 5 aa, Artificial Sequence
  Description of Artificial Sequence: Synthetic peptide
  XENP021141 vhCDR1
DAWMD

SEQ ID NO: 31157 - protein, 19 aa, Artificial Sequence
  Description of Artificial Sequence: Synthetic peptide
  XENP021141 vhCDR2
EIRTKANNHATYYAESVKG

SEQ ID NO: 31158 - protein, 10 aa, Artificial Sequence
  Description of Artificial Sequence: Synthetic peptide
  XENP021141 vhCDR3
LANWDWYFDV

SEQ ID NO: 31159 - protein, 218 aa, Artificial Sequence; identical to SEQ ID NO: 20330
  Description of Artificial Sequence: Synthetic polypeptide
  XENP021141 7G8_H0_L0.64_Fab Light Chain

SEQ ID NO: 31160 - protein, 111 aa, Artificial Sequence; identical to SEQ ID NO: 20331
  Description of Artificial Sequence: Synthetic polypeptide
  VL of XENP021141

SEQ ID NO: 31161 - protein, 15 aa, Artificial Sequence
  Description of Artificial Sequence: Synthetic peptide
  XENP021141 vlCDR1
KASQSVDYDGDSYMN

SEQ ID NO: 31162 - protein, 7 aa, Artificial Sequence
  Description of Artificial Sequence: Synthetic peptide
  XENP021141 vlCDR2
AASGLES

SEQ ID NO: 31163 - protein, 9 aa, Artificial Sequence
  Description of Artificial Sequence: Synthetic peptide
  XENP021141 vlCDR3
QQSNEDPFT

SEQ ID NO: 31164 - protein, 226 aa, Artificial Sequence; identical to SEQ ID NO: 29134
  Description of Artificial Sequence: Synthetic polypeptide
  XENP021142 7G8_H0_L0.65_Fab Heavy Chain

SEQ ID NO: 31165 - protein, 121 aa, Artificial Sequence; identical to SEQ ID NO: 17586
  Description of Artificial Sequence: Synthetic polypeptide
  VH of XENP021142

SEQ ID NO: 31166 - protein, 5 aa, Artificial Sequence
  Description of Artificial Sequence: Synthetic peptide
  XENP021142 vhCDR1
DAWMD

SEQ ID NO: 31167 - protein, 19 aa, Artificial Sequence
  Description of Artificial Sequence: Synthetic peptide
  XENP021142 vhCDR2
EIRTKANNHATYYAESVKG

SEQ ID NO: 31168 - protein, 10 aa, Artificial Sequence
  Description of Artificial Sequence: Synthetic peptide
  XENP021142 vhCDR3
LANWDWYFDV

SEQ ID NO: 31169 - protein, 218 aa, Artificial Sequence; identical to SEQ ID NO: 20340
  Description of Artificial Sequence: Synthetic polypeptide
  XENP021142 7G8_H0_L0.65_Fab Light Chain

SEQ ID NO: 31170 - protein, 111 aa, Artificial Sequence; identical to SEQ ID NO: 20341
  Description of Artificial Sequence: Synthetic polypeptide
  VL of XENP021142

SEQ ID NO: 31171 - protein, 15 aa, Artificial Sequence
  Description of Artificial Sequence: Synthetic peptide
  XENP021142 vlCDR1
KASQSVDYDGDSYMN

SEQ ID NO: 31172 - protein, 7 aa, Artificial Sequence
  Description of Artificial Sequence: Synthetic peptide
  XENP021142 vlCDR2
AASYLES

SEQ ID NO: 31173 - protein, 9 aa, Artificial Sequence
  Description of Artificial Sequence: Synthetic peptide
  XENP021142 vlCDR3
QQSNEDPFT

SEQ ID NO: 31174 - protein, 226 aa, Artificial Sequence; identical to SEQ ID NO: 29134
  Description of Artificial Sequence: Synthetic polypeptide
  XENP021143 7G8_H0_L0.66_Fab Heavy Chain

SEQ ID NO: 31175 - protein, 121 aa, Artificial Sequence; identical to SEQ ID NO: 17586
  Description of Artificial Sequence: Synthetic polypeptide
  VH of XENP021143

SEQ ID NO: 31176 - protein, 5 aa, Artificial Sequence
  Description of Artificial Sequence: Synthetic peptide
  XENP021143 vhCDR1
DAWMD

SEQ ID NO: 31177 - protein, 19 aa, Artificial Sequence
  Description of Artificial Sequence: Synthetic peptide
  XENP021143 vhCDR2
EIRTKANNHATYYAESVKG

SEQ ID NO: 31178 - protein, 10 aa, Artificial Sequence
  Description of Artificial Sequence: Synthetic peptide
  XENP021143 vhCDR3
LANWDWYFDV

SEQ ID NO: 31179 - protein, 218 aa, Artificial Sequence; identical to SEQ ID NO: 20350
  Description of Artificial Sequence: Synthetic polypeptide
  XENP021143 7G8_H0_L0.66_Fab Light Chain

SEQ ID NO: 31180 - protein, 111 aa, Artificial Sequence; identical to SEQ ID NO: 20351
  Description of Artificial Sequence: Synthetic polypeptide
  VL of XENP021143

SEQ ID NO: 31181 - protein, 15 aa, Artificial Sequence
  Description of Artificial Sequence: Synthetic peptide
  XENP021143 vlCDR1
KASQSVDYDGDSYMN

SEQ ID NO: 31182 - protein, 7 aa, Artificial Sequence
  Description of Artificial Sequence: Synthetic peptide
  XENP021143 vlCDR2
AASNLQS

SEQ ID NO: 31183 - protein, 9 aa, Artificial Sequence
  Description of Artificial Sequence: Synthetic peptide
  XENP021143 vlCDR3
QQSNEDPFT

SEQ ID NO: 31184 - protein, 226 aa, Artificial Sequence; identical to SEQ ID NO: 29134
  Description of Artificial Sequence: Synthetic polypeptide
  XENP021144 7G8_H0_L0.67_Fab Heavy Chain

SEQ ID NO: 31185 - protein, 121 aa, Artificial Sequence; identical to SEQ ID NO: 17586
  Description of Artificial Sequence: Synthetic polypeptide
  VH of XENP021144

SEQ ID NO: 31186 - protein, 5 aa, Artificial Sequence
  Description of Artificial Sequence: Synthetic peptide
  XENP021144 vhCDR1
DAWMD

SEQ ID NO: 31187 - protein, 19 aa, Artificial Sequence
  Description of Artificial Sequence: Synthetic peptide
  XENP021144 vhCDR2
EIRTKANNHATYYAESVKG

SEQ ID NO: 31188 - protein, 10 aa, Artificial Sequence
  Description of Artificial Sequence: Synthetic peptide
  XENP021144 vhCDR3
LANWDWYFDV

SEQ ID NO: 31189 - protein, 218 aa, Artificial Sequence; identical to SEQ ID NO: 20360
  Description of Artificial Sequence: Synthetic polypeptide
  XENP021144 7G8_H0_L0.67_Fab Light Chain

SEQ ID NO: 31190 - protein, 111 aa, Artificial Sequence; identical to SEQ ID NO: 20361
  Description of Artificial Sequence: Synthetic polypeptide
  VL of XENP021144

SEQ ID NO: 31191 - protein, 15 aa, Artificial Sequence
  Description of Artificial Sequence: Synthetic peptide
  XENP021144 vlCDR1
KASQSVDYDGDSYMN

SEQ ID NO: 31192 - protein, 7 aa, Artificial Sequence
  Description of Artificial Sequence: Synthetic peptide
  XENP021144 vlCDR2
AASNLDS

SEQ ID NO: 31193 - protein, 9 aa, Artificial Sequence
  Description of Artificial Sequence: Synthetic peptide
  XENP021144 vlCDR3
QQSNEDPFT

SEQ ID NO: 31194 - protein, 226 aa, Artificial Sequence; identical to SEQ ID NO: 29134
  Description of Artificial Sequence: Synthetic polypeptide
  XENP021145 7G8_H0_L0.68_Fab Heavy Chain

SEQ ID NO: 31195 - protein, 121 aa, Artificial Sequence; identical to SEQ ID NO: 17586
  Description of Artificial Sequence: Synthetic polypeptide
  VH of XENP021145

SEQ ID NO: 31196 - protein, 5 aa, Artificial Sequence
  Description of Artificial Sequence: Synthetic peptide
  XENP021145 vhCDR1
DAWMD

SEQ ID NO: 31197 - protein, 19 aa, Artificial Sequence
  Description of Artificial Sequence: Synthetic peptide
  XENP021145 vhCDR2
EIRTKANNHATYYAESVKG

SEQ ID NO: 31198 - protein, 10 aa, Artificial Sequence
  Description of Artificial Sequence: Synthetic peptide
  XENP021145 vhCDR3
LANWDWYFDV

SEQ ID NO: 31199 - protein, 218 aa, Artificial Sequence; identical to SEQ ID NO: 20370
  Description of Artificial Sequence: Synthetic polypeptide
  XENP021145 7G8_H0_L0.68_Fab Light Chain

SEQ ID NO: 31200 - protein, 111 aa, Artificial Sequence; identical to SEQ ID NO: 20371
  Description of Artificial Sequence: Synthetic polypeptide
  VL of XENP021145

SEQ ID NO: 31201 - protein, 15 aa, Artificial Sequence
  Description of Artificial Sequence: Synthetic peptide
  XENP021145 vlCDR1
KASQSVDYDGDSYMN

SEQ ID NO: 31202 - protein, 7 aa, Artificial Sequence
  Description of Artificial Sequence: Synthetic peptide
  XENP021145 vlCDR2
AASNLKS

SEQ ID NO: 31203 - protein, 9 aa, Artificial Sequence
  Description of Artificial Sequence: Synthetic peptide
  XENP021145 vlCDR3
QQSNEDPFT

SEQ ID NO: 31204 - protein, 226 aa, Artificial Sequence; identical to SEQ ID NO: 29134
  Description of Artificial Sequence: Synthetic polypeptide
  XENP021146 7G8_H0_L0.69_Fab Heavy Chain

SEQ ID NO: 31205 - protein, 121 aa, Artificial Sequence; identical to SEQ ID NO: 17586
  Description of Artificial Sequence: Synthetic polypeptide
  VH of XENP021146

SEQ ID NO: 31206 - protein, 5 aa, Artificial Sequence
  Description of Artificial Sequence: Synthetic peptide
  XENP021146 vhCDR1
DAWMD

SEQ ID NO: 31207 - protein, 19 aa, Artificial Sequence
  Description of Artificial Sequence: Synthetic peptide
  XENP021146 vhCDR2
EIRTKANNHATYYAESVKG

SEQ ID NO: 31208 - protein, 10 aa, Artificial Sequence
  Description of Artificial Sequence: Synthetic peptide
  XENP021146 vhCDR3
LANWDWYFDV

SEQ ID NO: 31209 - protein, 218 aa, Artificial Sequence; identical to SEQ ID NO: 20380
  Description of Artificial Sequence: Synthetic polypeptide
  XENP021146 7G8_H0_L0.69_Fab Light Chain

SEQ ID NO: 31210 - protein, 111 aa, Artificial Sequence; identical to SEQ ID NO: 20381
  Description of Artificial Sequence: Synthetic polypeptide
  VL of XENP021146

SEQ ID NO: 31211 - protein, 15 aa, Artificial Sequence
  Description of Artificial Sequence: Synthetic peptide
  XENP021146 vlCDR1
KASQSVDYDGDSYMN

SEQ ID NO: 31212 - protein, 7 aa, Artificial Sequence
  Description of Artificial Sequence: Synthetic peptide
  XENP021146 vlCDR2
AASNLHS

SEQ ID NO: 31213 - protein, 9 aa, Artificial Sequence
  Description of Artificial Sequence: Synthetic peptide
  XENP021146 vlCDR3
QQSNEDPFT

SEQ ID NO: 31214 - protein, 226 aa, Artificial Sequence; identical to SEQ ID NO: 29134
  Description of Artificial Sequence: Synthetic polypeptide
  XENP021147 7G8_H0_L0.70_Fab Heavy Chain

SEQ ID NO: 31215 - protein, 121 aa, Artificial Sequence; identical to SEQ ID NO: 17586
  Description of Artificial Sequence: Synthetic polypeptide
  VH of XENP021147

SEQ ID NO: 31216 - protein, 5 aa, Artificial Sequence
  Description of Artificial Sequence: Synthetic peptide
  XENP021147 vhCDR1
DAWMD

SEQ ID NO: 31217 - protein, 19 aa, Artificial Sequence
  Description of Artificial Sequence: Synthetic peptide
  XENP021147 vhCDR2
EIRTKANNHATYYAESVKG

SEQ ID NO: 31218 - protein, 10 aa, Artificial Sequence
  Description of Artificial Sequence: Synthetic peptide
  XENP021147 vhCDR3
LANWDWYFDV

SEQ ID NO: 31219 - protein, 218 aa, Artificial Sequence; identical to SEQ ID NO: 20390
  Description of Artificial Sequence: Synthetic polypeptide
  XENP021147 7G8_H0_L0.70_Fab Light Chain

SEQ ID NO: 31220 - protein, 111 aa, Artificial Sequence; identical to SEQ ID NO: 20391
  Description of Artificial Sequence: Synthetic polypeptide
  VL of XENP021147

SEQ ID NO: 31221 - protein, 15 aa, Artificial Sequence
  Description of Artificial Sequence: Synthetic peptide
  XENP021147 vlCDR1
KASQSVDYDGDSYMN

SEQ ID NO: 31222 - protein, 7 aa, Artificial Sequence
  Description of Artificial Sequence: Synthetic peptide
  XENP021147 vlCDR2
AASNLAS

SEQ ID NO: 31223 - protein, 9 aa, Artificial Sequence
  Description of Artificial Sequence: Synthetic peptide
  XENP021147 vlCDR3
QQSNEDPFT

SEQ ID NO: 31224 - protein, 226 aa, Artificial Sequence; identical to SEQ ID NO: 29134
  Description of Artificial Sequence: Synthetic polypeptide
  XENP021148 7G8_H0_L0.71_Fab Heavy Chain

SEQ ID NO: 31225 - protein, 121 aa, Artificial Sequence; identical to SEQ ID NO: 17586
  Description of Artificial Sequence: Synthetic polypeptide
  VH of XENP021148

SEQ ID NO: 31226 - protein, 5 aa, Artificial Sequence
  Description of Artificial Sequence: Synthetic peptide
  XENP021148 vhCDR1
DAWMD

SEQ ID NO: 31227 - protein, 19 aa, Artificial Sequence
  Description of Artificial Sequence: Synthetic peptide
  XENP021148 vhCDR2
EIRTKANNHATYYAESVKG

SEQ ID NO: 31228 - protein, 10 aa, Artificial Sequence
  Description of Artificial Sequence: Synthetic peptide
  XENP021148 vhCDR3
LANWDWYFDV

SEQ ID NO: 31229 - protein, 218 aa, Artificial Sequence; identical to SEQ ID NO: 20400
  Description of Artificial Sequence: Synthetic polypeptide
  XENP021148 7G8_H0_L0.71_Fab Light Chain

SEQ ID NO: 31230 - protein, 111 aa, Artificial Sequence; identical to SEQ ID NO: 20401
  Description of Artificial Sequence: Synthetic polypeptide
  VL of XENP021148

SEQ ID NO: 31231 - protein, 15 aa, Artificial Sequence
  Description of Artificial Sequence: Synthetic peptide
  XENP021148 vlCDR1
KASQSVDYDGDSYMN

SEQ ID NO: 31232 - protein, 7 aa, Artificial Sequence
  Description of Artificial Sequence: Synthetic peptide
  XENP021148 vlCDR2
AASNLGS

SEQ ID NO: 31233 - protein, 9 aa, Artificial Sequence
  Description of Artificial Sequence: Synthetic peptide
  XENP021148 vlCDR3
QQSNEDPFT

SEQ ID NO: 31234 - protein, 226 aa, Artificial Sequence; identical to SEQ ID NO: 29134
  Description of Artificial Sequence: Synthetic polypeptide
  XENP021149 7G8_H0_L0.72_Fab Heavy Chain

SEQ ID NO: 31235 - protein, 121 aa, Artificial Sequence; identical to SEQ ID NO: 17586
  Description of Artificial Sequence: Synthetic polypeptide
  VH of XENP021149

SEQ ID NO: 31236 - protein, 5 aa, Artificial Sequence
  Description of Artificial Sequence: Synthetic peptide
  XENP021149 vhCDR1
DAWMD

SEQ ID NO: 31237 - protein, 19 aa, Artificial Sequence
  Description of Artificial Sequence: Synthetic peptide
  XENP021149 vhCDR2
EIRTKANNHATYYAESVKG

SEQ ID NO: 31238 - protein, 10 aa, Artificial Sequence
  Description of Artificial Sequence: Synthetic peptide
  XENP021149 vhCDR3
LANWDWYFDV

SEQ ID NO: 31239 - protein, 218 aa, Artificial Sequence; identical to SEQ ID NO: 20410
  Description of Artificial Sequence: Synthetic polypeptide
  XENP021149 7G8_H0_L0.72_Fab Light Chain

SEQ ID NO: 31240 - protein, 111 aa, Artificial Sequence; identical to SEQ ID NO: 20411
  Description of Artificial Sequence: Synthetic polypeptide
  VL of XENP021149

SEQ ID NO: 31241 - protein, 15 aa, Artificial Sequence
  Description of Artificial Sequence: Synthetic peptide
  XENP021149 vlCDR1
KASQSVDYDGDSYMN

SEQ ID NO: 31242 - protein, 7 aa, Artificial Sequence
  Description of Artificial Sequence: Synthetic peptide
  XENP021149 vlCDR2
AASNLYS

SEQ ID NO: 31243 - protein, 9 aa, Artificial Sequence
  Description of Artificial Sequence: Synthetic peptide
  XENP021149 vlCDR3
QQSNEDPFT

SEQ ID NO: 31244 - protein, 226 aa, Artificial Sequence; identical to SEQ ID NO: 29134
  Description of Artificial Sequence: Synthetic polypeptide
  XENP021150 7G8_H0_L0.73_Fab Heavy Chain

SEQ ID NO: 31245 - protein, 121 aa, Artificial Sequence; identical to SEQ ID NO: 17586
  Description of Artificial Sequence: Synthetic polypeptide
  VH of XENP021150

SEQ ID NO: 31246 - protein, 5 aa, Artificial Sequence
  Description of Artificial Sequence: Synthetic peptide
  XENP021150 vhCDR1
DAWMD

SEQ ID NO: 31247 - protein, 19 aa, Artificial Sequence
  Description of Artificial Sequence: Synthetic peptide
  XENP021150 vhCDR2
EIRTKANNHATYYAESVKG

SEQ ID NO: 31248 - protein, 10 aa, Artificial Sequence
  Description of Artificial Sequence: Synthetic peptide
  XENP021150 vhCDR3
LANWDWYFDV

SEQ ID NO: 31249 - protein, 218 aa, Artificial Sequence; identical to SEQ ID NO: 20420
  Description of Artificial Sequence: Synthetic polypeptide
  XENP021150 7G8_H0_L0.73_Fab Light Chain

SEQ ID NO: 31250 - protein, 111 aa, Artificial Sequence; identical to SEQ ID NO: 20421
  Description of Artificial Sequence: Synthetic polypeptide
  VL of XENP021150

SEQ ID NO: 31251 - protein, 15 aa, Artificial Sequence
  Description of Artificial Sequence: Synthetic peptide
  XENP021150 vlCDR1
KASQSVDYDGDSYMN

SEQ ID NO: 31252 - protein, 7 aa, Artificial Sequence
  Description of Artificial Sequence: Synthetic peptide
  XENP021150 vlCDR2
AASNLIS

SEQ ID NO: 31253 - protein, 9 aa, Artificial Sequence
  Description of Artificial Sequence: Synthetic peptide
  XENP021150 vlCDR3
QQSNEDPFT

SEQ ID NO: 31254 - protein, 226 aa, Artificial Sequence; identical to SEQ ID NO: 29134
  Description of Artificial Sequence: Synthetic polypeptide
  XENP021151 7G8_H0_L0.74_Fab Heavy Chain

SEQ ID NO: 31255 - protein, 121 aa, Artificial Sequence; identical to SEQ ID NO: 17586
  Description of Artificial Sequence: Synthetic polypeptide
  VH of XENP021151

SEQ ID NO: 31256 - protein, 5 aa, Artificial Sequence
  Description of Artificial Sequence: Synthetic peptide
  XENP021151 vhCDR1
DAWMD

SEQ ID NO: 31257 - protein, 19 aa, Artificial Sequence
  Description of Artificial Sequence: Synthetic peptide
  XENP021151 vhCDR2
EIRTKANNHATYYAESVKG

SEQ ID NO: 31258 - protein, 10 aa, Artificial Sequence
  Description of Artificial Sequence: Synthetic peptide
  XENP021151 vhCDR3
LANWDWYFDV

SEQ ID NO: 31259 - protein, 218 aa, Artificial Sequence; identical to SEQ ID NO: 20430
  Description of Artificial Sequence: Synthetic polypeptide
  XENP021151 7G8_H0_L0.74_Fab Light Chain

SEQ ID NO: 31260 - protein, 111 aa, Artificial Sequence; identical to SEQ ID NO: 20431
  Description of Artificial Sequence: Synthetic polypeptide
  VL of XENP021151

SEQ ID NO: 31261 - protein, 15 aa, Artificial Sequence
  Description of Artificial Sequence: Synthetic peptide
  XENP021151 vlCDR1
KASQSVDYDGDSYMN

SEQ ID NO: 31262 - protein, 7 aa, Artificial Sequence
  Description of Artificial Sequence: Synthetic peptide
  XENP021151 vlCDR2
AASNLES

SEQ ID NO: 31263 - protein, 9 aa, Artificial Sequence
  Description of Artificial Sequence: Synthetic peptide
  XENP021151 vlCDR3
QQTNEDPFT

SEQ ID NO: 31264 - protein, 226 aa, Artificial Sequence; identical to SEQ ID NO: 29134
  Description of Artificial Sequence: Synthetic polypeptide
  XENP021152 7G8_H0_L0.75_Fab Heavy Chain

SEQ ID NO: 31265 - protein, 121 aa, Artificial Sequence; identical to SEQ ID NO: 17586
  Description of Artificial Sequence: Synthetic polypeptide
  VH of XENP021152

SEQ ID NO: 31266 - protein, 5 aa, Artificial Sequence
  Description of Artificial Sequence: Synthetic peptide
  XENP021152 vhCDR1
DAWMD

SEQ ID NO: 31267 - protein, 19 aa, Artificial Sequence
  Description of Artificial Sequence: Synthetic peptide
  XENP021152 vhCDR2
EIRTKANNHATYYAESVKG

SEQ ID NO: 31268 - protein, 10 aa, Artificial Sequence
  Description of Artificial Sequence: Synthetic peptide
  XENP021152 vhCDR3
LANWDWYFDV

SEQ ID NO: 31269 - protein, 218 aa, Artificial Sequence; identical to SEQ ID NO: 20440
  Description of Artificial Sequence: Synthetic polypeptide
  XENP021152 7G8_H0_L0.75_Fab Light Chain

SEQ ID NO: 31270 - protein, 111 aa, Artificial Sequence; identical to SEQ ID NO: 20441
  Description of Artificial Sequence: Synthetic polypeptide
  VL of XENP021152

SEQ ID NO: 31271 - protein, 15 aa, Artificial Sequence
  Description of Artificial Sequence: Synthetic peptide
  XENP021152 vlCDR1
KASQSVDYDGDSYMN

SEQ ID NO: 31272 - protein, 7 aa, Artificial Sequence
  Description of Artificial Sequence: Synthetic peptide
  XENP021152 vlCDR2
AASNLES

SEQ ID NO: 31273 - protein, 9 aa, Artificial Sequence
  Description of Artificial Sequence: Synthetic peptide
  XENP021152 vlCDR3
QQANEDPFT

SEQ ID NO: 31274 - protein, 226 aa, Artificial Sequence; identical to SEQ ID NO: 29134
  Description of Artificial Sequence: Synthetic polypeptide
  XENP021153 7G8_H0_L0.76_Fab Heavy Chain

SEQ ID NO: 31275 - protein, 121 aa, Artificial Sequence; identical to SEQ ID NO: 17586
  Description of Artificial Sequence: Synthetic polypeptide
  VH of XENP021153

SEQ ID NO: 31276 - protein, 5 aa, Artificial Sequence
  Description of Artificial Sequence: Synthetic peptide
  XENP021153 vhCDR1
DAWMD

SEQ ID NO: 31277 - protein, 19 aa, Artificial Sequence
  Description of Artificial Sequence: Synthetic peptide
  XENP021153 vhCDR2
EIRTKANNHATYYAESVKG

SEQ ID NO: 31278 - protein, 10 aa, Artificial Sequence
  Description of Artificial Sequence: Synthetic peptide
  XENP021153 vhCDR3
LANWDWYFDV

SEQ ID NO: 31279 - protein, 218 aa, Artificial Sequence; identical to SEQ ID NO: 20450
  Description of Artificial Sequence: Synthetic polypeptide
  XENP021153 7G8_H0_L0.76_Fab Light Chain

SEQ ID NO: 31280 - protein, 111 aa, Artificial Sequence; identical to SEQ ID NO: 20451
  Description of Artificial Sequence: Synthetic polypeptide
  VL of XENP021153

SEQ ID NO: 31281 - protein, 15 aa, Artificial Sequence
  Description of Artificial Sequence: Synthetic peptide
  XENP021153 vlCDR1
KASQSVDYDGDSYMN

SEQ ID NO: 31282 - protein, 7 aa, Artificial Sequence
  Description of Artificial Sequence: Synthetic peptide
  XENP021153 vlCDR2
AASNLES

SEQ ID NO: 31283 - protein, 9 aa, Artificial Sequence
  Description of Artificial Sequence: Synthetic peptide
  XENP021153 vlCDR3
QQQNEDPFT

SEQ ID NO: 31284 - protein, 226 aa, Artificial Sequence; identical to SEQ ID NO: 29134
  Description of Artificial Sequence: Synthetic polypeptide
  XENP021154 7G8_H0_L0.77_Fab Heavy Chain

SEQ ID NO: 31285 - protein, 121 aa, Artificial Sequence; identical to SEQ ID NO: 17586
  Description of Artificial Sequence: Synthetic polypeptide
  VH of XENP021154

SEQ ID NO: 31286 - protein, 5 aa, Artificial Sequence
  Description of Artificial Sequence: Synthetic peptide
  XENP021154 vhCDR1
DAWMD

SEQ ID NO: 31287 - protein, 19 aa, Artificial Sequence
  Description of Artificial Sequence: Synthetic peptide
  XENP021154 vhCDR2
EIRTKANNHATYYAESVKG

SEQ ID NO: 31288 - protein, 10 aa, Artificial Sequence
  Description of Artificial Sequence: Synthetic peptide
  XENP021154 vhCDR3
LANWDWYFDV

SEQ ID NO: 31289 - protein, 218 aa, Artificial Sequence; identical to SEQ ID NO: 20460
  Description of Artificial Sequence: Synthetic polypeptide
  XENP021154 7G8_H0_L0.77_Fab Light Chain

SEQ ID NO: 31290 - protein, 111 aa, Artificial Sequence; identical to SEQ ID NO: 20461
  Description of Artificial Sequence: Synthetic polypeptide
  VL of XENP021154

SEQ ID NO: 31291 - protein, 15 aa, Artificial Sequence
  Description of Artificial Sequence: Synthetic peptide
  XENP021154 vlCDR1
KASQSVDYDGDSYMN

SEQ ID NO: 31292 - protein, 7 aa, Artificial Sequence
  Description of Artificial Sequence: Synthetic peptide
  XENP021154 vlCDR2
AASNLES

SEQ ID NO: 31293 - protein, 9 aa, Artificial Sequence
  Description of Artificial Sequence: Synthetic peptide
  XENP021154 vlCDR3
QQGNEDPFT

SEQ ID NO: 31294 - protein, 226 aa, Artificial Sequence; identical to SEQ ID NO: 29134
  Description of Artificial Sequence: Synthetic polypeptide
  XENP021155 7G8_H0_L0.78_Fab Heavy Chain

SEQ ID NO: 31295 - protein, 121 aa, Artificial Sequence; identical to SEQ ID NO: 17586
  Description of Artificial Sequence: Synthetic polypeptide
  VH of XENP021155

SEQ ID NO: 31296 - protein, 5 aa, Artificial Sequence
  Description of Artificial Sequence: Synthetic peptide
  XENP021155 vhCDR1
DAWMD

SEQ ID NO: 31297 - protein, 19 aa, Artificial Sequence
  Description of Artificial Sequence: Synthetic peptide
  XENP021155 vhCDR2
EIRTKANNHATYYAESVKG

SEQ ID NO: 31298 - protein, 10 aa, Artificial Sequence
  Description of Artificial Sequence: Synthetic peptide
  XENP021155 vhCDR3
LANWDWYFDV

SEQ ID NO: 31299 - protein, 218 aa, Artificial Sequence; identical to SEQ ID NO: 20470
  Description of Artificial Sequence: Synthetic polypeptide
  XENP021155 7G8_H0_L0.78_Fab Light Chain

SEQ ID NO: 31300 - protein, 111 aa, Artificial Sequence; identical to SEQ ID NO: 20471
  Description of Artificial Sequence: Synthetic polypeptide
  VL of XENP021155

SEQ ID NO: 31301 - protein, 15 aa, Artificial Sequence
  Description of Artificial Sequence: Synthetic peptide
  XENP021155 vlCDR1
KASQSVDYDGDSYMN

SEQ ID NO: 31302 - protein, 7 aa, Artificial Sequence
  Description of Artificial Sequence: Synthetic peptide
  XENP021155 vlCDR2
AASNLES

SEQ ID NO: 31303 - protein, 9 aa, Artificial Sequence
  Description of Artificial Sequence: Synthetic peptide
  XENP021155 vlCDR3
QQVNEDPFT

SEQ ID NO: 31304 - protein, 226 aa, Artificial Sequence; identical to SEQ ID NO: 29134
  Description of Artificial Sequence: Synthetic polypeptide
  XENP021156 7G8_H0_L0.79_Fab Heavy Chain

SEQ ID NO: 31305 - protein, 121 aa, Artificial Sequence; identical to SEQ ID NO: 17586
  Description of Artificial Sequence: Synthetic polypeptide
  VH of XENP021156

SEQ ID NO: 31306 - protein, 5 aa, Artificial Sequence
  Description of Artificial Sequence: Synthetic peptide
  XENP021156 vhCDR1
DAWMD

SEQ ID NO: 31307 - protein, 19 aa, Artificial Sequence
  Description of Artificial Sequence: Synthetic peptide
  XENP021156 vhCDR2
EIRTKANNHATYYAESVKG

SEQ ID NO: 31308 - protein, 10 aa, Artificial Sequence
  Description of Artificial Sequence: Synthetic peptide
  XENP021156 vhCDR3
LANWDWYFDV

SEQ ID NO: 31309 - protein, 218 aa, Artificial Sequence; identical to SEQ ID NO: 20480
  Description of Artificial Sequence: Synthetic polypeptide
  XENP021156 7G8_H0_L0.79_Fab Light Chain

SEQ ID NO: 31310 - protein, 111 aa, Artificial Sequence; identical to SEQ ID NO: 20481
  Description of Artificial Sequence: Synthetic polypeptide
  VL of XENP021156

SEQ ID NO: 31311 - protein, 15 aa, Artificial Sequence
  Description of Artificial Sequence: Synthetic peptide
  XENP021156 vlCDR1
KASQSVDYDGDSYMN

SEQ ID NO: 31312 - protein, 7 aa, Artificial Sequence
  Description of Artificial Sequence: Synthetic peptide
  XENP021156 vlCDR2
AASNLES

SEQ ID NO: 31313 - protein, 9 aa, Artificial Sequence
  Description of Artificial Sequence: Synthetic peptide
  XENP021156 vlCDR3
QQHNEDPFT

SEQ ID NO: 31314 - protein, 226 aa, Artificial Sequence; identical to SEQ ID NO: 29134
  Description of Artificial Sequence: Synthetic polypeptide
  XENP021157 7G8_H0_L0.80_Fab Heavy Chain

SEQ ID NO: 31315 - protein, 121 aa, Artificial Sequence; identical to SEQ ID NO: 17586
  Description of Artificial Sequence: Synthetic polypeptide
  VH of XENP021157

SEQ ID NO: 31316 - protein, 5 aa, Artificial Sequence
  Description of Artificial Sequence: Synthetic peptide
  XENP021157 vhCDR1
DAWMD

SEQ ID NO: 31317 - protein, 19 aa, Artificial Sequence
  Description of Artificial Sequence: Synthetic peptide
  XENP021157 vhCDR2
EIRTKANNHATYYAESVKG

SEQ ID NO: 31318 - protein, 10 aa, Artificial Sequence
  Description of Artificial Sequence: Synthetic peptide
  XENP021157 vhCDR3
LANWDWYFDV

SEQ ID NO: 31319 - protein, 218 aa, Artificial Sequence; identical to SEQ ID NO: 20490
  Description of Artificial Sequence: Synthetic polypeptide
  XENP021157 7G8_H0_L0.80_Fab Light Chain

SEQ ID NO: 31320 - protein, 111 aa, Artificial Sequence; identical to SEQ ID NO: 20491
  Description of Artificial Sequence: Synthetic polypeptide
  VL of XENP021157

SEQ ID NO: 31321 - protein, 15 aa, Artificial Sequence
  Description of Artificial Sequence: Synthetic peptide
  XENP021157 vlCDR1
KASQSVDYDGDSYMN

SEQ ID NO: 31322 - protein, 7 aa, Artificial Sequence
  Description of Artificial Sequence: Synthetic peptide
  XENP021157 vlCDR2
AASNLES

SEQ ID NO: 31323 - protein, 9 aa, Artificial Sequence
  Description of Artificial Sequence: Synthetic peptide
  XENP021157 vlCDR3
QQDNEDPFT

SEQ ID NO: 31324 - protein, 226 aa, Artificial Sequence; identical to SEQ ID NO: 29134
  Description of Artificial Sequence: Synthetic polypeptide
  XENP021158 7G8_H0_L0.81_Fab Heavy Chain

SEQ ID NO: 31325 - protein, 121 aa, Artificial Sequence; identical to SEQ ID NO: 17586
  Description of Artificial Sequence: Synthetic polypeptide
  VH of XENP021158

SEQ ID NO: 31326 - protein, 5 aa, Artificial Sequence
  Description of Artificial Sequence: Synthetic peptide
  XENP021158 vhCDR1
DAWMD

SEQ ID NO: 31327 - protein, 19 aa, Artificial Sequence
  Description of Artificial Sequence: Synthetic peptide
  XENP021158 vhCDR2
EIRTKANNHATYYAESVKG

SEQ ID NO: 31328 - protein, 10 aa, Artificial Sequence
  Description of Artificial Sequence: Synthetic peptide
  XENP021158 vhCDR3
LANWDWYFDV

SEQ ID NO: 31329 - protein, 218 aa, Artificial Sequence; identical to SEQ ID NO: 20500
  Description of Artificial Sequence: Synthetic polypeptide
  XENP021158 7G8_H0_L0.81_Fab Light Chain

SEQ ID NO: 31330 - protein, 111 aa, Artificial Sequence; identical to SEQ ID NO: 20501
  Description of Artificial Sequence: Synthetic polypeptide
  VL of XENP021158

SEQ ID NO: 31331 - protein, 15 aa, Artificial Sequence
  Description of Artificial Sequence: Synthetic peptide
  XENP021158 vlCDR1
KASQSVDYDGDSYMN

SEQ ID NO: 31332 - protein, 7 aa, Artificial Sequence
  Description of Artificial Sequence: Synthetic peptide
  XENP021158 vlCDR2
AASNLES

SEQ ID NO: 31333 - protein, 9 aa, Artificial Sequence
  Description of Artificial Sequence: Synthetic peptide
  XENP021158 vlCDR3
QQKNEDPFT

SEQ ID NO: 31334 - protein, 226 aa, Artificial Sequence; identical to SEQ ID NO: 29134
  Description of Artificial Sequence: Synthetic polypeptide
  XENP021159 7G8_H0_L0.82_Fab Heavy Chain

SEQ ID NO: 31335 - protein, 121 aa, Artificial Sequence; identical to SEQ ID NO: 17586
  Description of Artificial Sequence: Synthetic polypeptide
  VH of XENP021159

SEQ ID NO: 31336 - protein, 5 aa, Artificial Sequence
  Description of Artificial Sequence: Synthetic peptide
  XENP021159 vhCDR1
DAWMD

SEQ ID NO: 31337 - protein, 19 aa, Artificial Sequence
  Description of Artificial Sequence: Synthetic peptide
  XENP021159 vhCDR2
EIRTKANNHATYYAESVKG

SEQ ID NO: 31338 - protein, 10 aa, Artificial Sequence
  Description of Artificial Sequence: Synthetic peptide
  XENP021159 vhCDR3
LANWDWYFDV

SEQ ID NO: 31339 - protein, 218 aa, Artificial Sequence; identical to SEQ ID NO: 20510
  Description of Artificial Sequence: Synthetic polypeptide
  XENP021159 7G8_H0_L0.82_Fab Light Chain

SEQ ID NO: 31340 - protein, 111 aa, Artificial Sequence; identical to SEQ ID NO: 20511
  Description of Artificial Sequence: Synthetic polypeptide
  VL of XENP021159

SEQ ID NO: 31341 - protein, 15 aa, Artificial Sequence
  Description of Artificial Sequence: Synthetic peptide
  XENP021159 vlCDR1
KASQSVDYDGDSYMN

SEQ ID NO: 31342 - protein, 7 aa, Artificial Sequence
  Description of Artificial Sequence: Synthetic peptide
  XENP021159 vlCDR2
AASNLES

SEQ ID NO: 31343 - protein, 9 aa, Artificial Sequence
  Description of Artificial Sequence: Synthetic peptide
  XENP021159 vlCDR3
QQYNEDPFT

SEQ ID NO: 31344 - protein, 226 aa, Artificial Sequence; identical to SEQ ID NO: 29134
  Description of Artificial Sequence: Synthetic polypeptide
  XENP021160 7G8_H0_L0.83_Fab Heavy Chain

SEQ ID NO: 31345 - protein, 121 aa, Artificial Sequence; identical to SEQ ID NO: 17586
  Description of Artificial Sequence: Synthetic polypeptide
  VH of XENP021160

SEQ ID NO: 31346 - protein, 5 aa, Artificial Sequence
  Description of Artificial Sequence: Synthetic peptide
  XENP021160 vhCDR1
DAWMD

SEQ ID NO: 31347 - protein, 19 aa, Artificial Sequence
  Description of Artificial Sequence: Synthetic peptide
  XENP021160 vhCDR2
EIRTKANNHATYYAESVKG

SEQ ID NO: 31348 - protein, 10 aa, Artificial Sequence
  Description of Artificial Sequence: Synthetic peptide
  XENP021160 vhCDR3
LANWDWYFDV

SEQ ID NO: 31349 - protein, 218 aa, Artificial Sequence; identical to SEQ ID NO: 20520
  Description of Artificial Sequence: Synthetic polypeptide
  XENP021160 7G8_H0_L0.83_Fab Light Chain

SEQ ID NO: 31350 - protein, 111 aa, Artificial Sequence; identical to SEQ ID NO: 20521
  Description of Artificial Sequence: Synthetic polypeptide
  VL of XENP021160

SEQ ID NO: 31351 - protein, 15 aa, Artificial Sequence
  Description of Artificial Sequence: Synthetic peptide
  XENP021160 vlCDR1
KASQSVDYDGDSYMN

SEQ ID NO: 31352 - protein, 7 aa, Artificial Sequence
  Description of Artificial Sequence: Synthetic peptide
  XENP021160 vlCDR2
AASNLES

SEQ ID NO: 31353 - protein, 9 aa, Artificial Sequence
  Description of Artificial Sequence: Synthetic peptide
  XENP021160 vlCDR3
QQSDEDPFT

SEQ ID NO: 31354 - protein, 226 aa, Artificial Sequence; identical to SEQ ID NO: 29134
  Description of Artificial Sequence: Synthetic polypeptide
  XENP021161 7G8_H0_L0.84_Fab Heavy Chain

SEQ ID NO: 31355 - protein, 121 aa, Artificial Sequence; identical to SEQ ID NO: 17586
  Description of Artificial Sequence: Synthetic polypeptide
  VH of XENP021161

SEQ ID NO: 31356 - protein, 5 aa, Artificial Sequence
  Description of Artificial Sequence: Synthetic peptide
  XENP021161 vhCDR1
DAWMD

SEQ ID NO: 31357 - protein, 19 aa, Artificial Sequence
  Description of Artificial Sequence: Synthetic peptide
  XENP021161 vhCDR2
EIRTKANNHATYYAESVKG

SEQ ID NO: 31358 - protein, 10 aa, Artificial Sequence
  Description of Artificial Sequence: Synthetic peptide
  XENP021161 vhCDR3
LANWDWYFDV

SEQ ID NO: 31359 - protein, 218 aa, Artificial Sequence; identical to SEQ ID NO: 20530
  Description of Artificial Sequence: Synthetic polypeptide
  XENP021161 7G8_H0_L0.84_Fab Light Chain

SEQ ID NO: 31360 - protein, 111 aa, Artificial Sequence; identical to SEQ ID NO: 20531
  Description of Artificial Sequence: Synthetic polypeptide
  VL of XENP021161

SEQ ID NO: 31361 - protein, 15 aa, Artificial Sequence
  Description of Artificial Sequence: Synthetic peptide
  XENP021161 vlCDR1
KASQSVDYDGDSYMN

SEQ ID NO: 31362 - protein, 7 aa, Artificial Sequence
  Description of Artificial Sequence: Synthetic peptide
  XENP021161 vlCDR2
AASNLES

SEQ ID NO: 31363 - protein, 9 aa, Artificial Sequence
  Description of Artificial Sequence: Synthetic peptide
  XENP021161 vlCDR3
QQSHEDPFT

SEQ ID NO: 31364 - protein, 226 aa, Artificial Sequence; identical to SEQ ID NO: 29134
  Description of Artificial Sequence: Synthetic polypeptide
  XENP021162 7G8_H0_L0.85_Fab Heavy Chain

SEQ ID NO: 31365 - protein, 121 aa, Artificial Sequence; identical to SEQ ID NO: 17586
  Description of Artificial Sequence: Synthetic polypeptide
  VH of XENP021162

SEQ ID NO: 31366 - protein, 5 aa, Artificial Sequence
  Description of Artificial Sequence: Synthetic peptide
  XENP021162 vhCDR1
DAWMD

SEQ ID NO: 31367 - protein, 19 aa, Artificial Sequence
  Description of Artificial Sequence: Synthetic peptide
  XENP021162 vhCDR2
EIRTKANNHATYYAESVKG

SEQ ID NO: 31368 - protein, 10 aa, Artificial Sequence
  Description of Artificial Sequence: Synthetic peptide
  XENP021162 vhCDR3
LANWDWYFDV

SEQ ID NO: 31369 - protein, 218 aa, Artificial Sequence; identical to SEQ ID NO: 20540
  Description of Artificial Sequence: Synthetic polypeptide
  XENP021162 7G8_H0_L0.85_Fab Light Chain

SEQ ID NO: 31370 - protein, 111 aa, Artificial Sequence; identical to SEQ ID NO: 20541
  Description of Artificial Sequence: Synthetic polypeptide
  VL of XENP021162

SEQ ID NO: 31371 - protein, 15 aa, Artificial Sequence
  Description of Artificial Sequence: Synthetic peptide
  XENP021162 vlCDR1
KASQSVDYDGDSYMN

SEQ ID NO: 31372 - protein, 7 aa, Artificial Sequence
  Description of Artificial Sequence: Synthetic peptide
  XENP021162 vlCDR2
AASNLES

SEQ ID NO: 31373 - protein, 9 aa, Artificial Sequence
  Description of Artificial Sequence: Synthetic peptide
  XENP021162 vlCDR3
QQSEEDPFT

SEQ ID NO: 31374 - protein, 226 aa, Artificial Sequence; identical to SEQ ID NO: 29134
  Description of Artificial Sequence: Synthetic polypeptide
  XENP021163 7G8_H0_L0.86_Fab Heavy Chain

SEQ ID NO: 31375 - protein, 121 aa, Artificial Sequence; identical to SEQ ID NO: 17586
  Description of Artificial Sequence: Synthetic polypeptide
  VH of XENP021163

SEQ ID NO: 31376 - protein, 5 aa, Artificial Sequence
  Description of Artificial Sequence: Synthetic peptide
  XENP021163 vhCDR1
DAWMD

SEQ ID NO: 31377 - protein, 19 aa, Artificial Sequence
  Description of Artificial Sequence: Synthetic peptide
  XENP021163 vhCDR2
EIRTKANNHATYYAESVKG

SEQ ID NO: 31378 - protein, 10 aa, Artificial Sequence
  Description of Artificial Sequence: Synthetic peptide
  XENP021163 vhCDR3
LANWDWYFDV

SEQ ID NO: 31379 - protein, 218 aa, Artificial Sequence; identical to SEQ ID NO: 20550
  Description of Artificial Sequence: Synthetic polypeptide
  XENP021163 7G8_H0_L0.86_Fab Light Chain

SEQ ID NO: 31380 - protein, 111 aa, Artificial Sequence; identical to SEQ ID NO: 20551
  Description of Artificial Sequence: Synthetic polypeptide
  VL of XENP021163

SEQ ID NO: 31381 - protein, 15 aa, Artificial Sequence
  Description of Artificial Sequence: Synthetic peptide
  XENP021163 vlCDR1
KASQSVDYDGDSYMN

SEQ ID NO: 31382 - protein, 7 aa, Artificial Sequence
  Description of Artificial Sequence: Synthetic peptide
  XENP021163 vlCDR2
AASNLES

SEQ ID NO: 31383 - protein, 9 aa, Artificial Sequence
  Description of Artificial Sequence: Synthetic peptide
  XENP021163 vlCDR3
QQSSEDPFT

SEQ ID NO: 31384 - protein, 226 aa, Artificial Sequence; identical to SEQ ID NO: 29134
  Description of Artificial Sequence: Synthetic polypeptide
  XENP021164 7G8_H0_L0.87_Fab Heavy Chain

SEQ ID NO: 31385 - protein, 121 aa, Artificial Sequence; identical to SEQ ID NO: 17586
  Description of Artificial Sequence: Synthetic polypeptide
  VH of XENP021164

SEQ ID NO: 31386 - protein, 5 aa, Artificial Sequence
  Description of Artificial Sequence: Synthetic peptide
  XENP021164 vhCDR1
DAWMD

SEQ ID NO: 31387 - protein, 19 aa, Artificial Sequence
  Description of Artificial Sequence: Synthetic peptide
  XENP021164 vhCDR2
EIRTKANNHATYYAESVKG

SEQ ID NO: 31388 - protein, 10 aa, Artificial Sequence
  Description of Artificial Sequence: Synthetic peptide
  XENP021164 vhCDR3
LANWDWYFDV

SEQ ID NO: 31389 - protein, 218 aa, Artificial Sequence; identical to SEQ ID NO: 20560
  Description of Artificial Sequence: Synthetic polypeptide
  XENP021164 7G8_H0_L0.87_Fab Light Chain

SEQ ID NO: 31390 - protein, 111 aa, Artificial Sequence; identical to SEQ ID NO: 20561
  Description of Artificial Sequence: Synthetic polypeptide
  VL of XENP021164

SEQ ID NO: 31391 - protein, 15 aa, Artificial Sequence
  Description of Artificial Sequence: Synthetic peptide
  XENP021164 vlCDR1
KASQSVDYDGDSYMN

SEQ ID NO: 31392 - protein, 7 aa, Artificial Sequence
  Description of Artificial Sequence: Synthetic peptide
  XENP021164 vlCDR2
AASNLES

SEQ ID NO: 31393 - protein, 9 aa, Artificial Sequence
  Description of Artificial Sequence: Synthetic peptide
  XENP021164 vlCDR3
QQSREDPFT

SEQ ID NO: 31394 - protein, 226 aa, Artificial Sequence; identical to SEQ ID NO: 29134
  Description of Artificial Sequence: Synthetic polypeptide
  XENP021165 7G8_H0_L0.88_Fab Heavy Chain

SEQ ID NO: 31395 - protein, 121 aa, Artificial Sequence; identical to SEQ ID NO: 17586
  Description of Artificial Sequence: Synthetic polypeptide
  VH of XENP021165

SEQ ID NO: 31396 - protein, 5 aa, Artificial Sequence
  Description of Artificial Sequence: Synthetic peptide
  XENP021165 vhCDR1
DAWMD

SEQ ID NO: 31397 - protein, 19 aa, Artificial Sequence
  Description of Artificial Sequence: Synthetic peptide
  XENP021165 vhCDR2
EIRTKANNHATYYAESVKG

SEQ ID NO: 31398 - protein, 10 aa, Artificial Sequence
  Description of Artificial Sequence: Synthetic peptide
  XENP021165 vhCDR3
LANWDWYFDV

SEQ ID NO: 31399 - protein, 218 aa, Artificial Sequence; identical to SEQ ID NO: 20570
  Description of Artificial Sequence: Synthetic polypeptide
  XENP021165 7G8_H0_L0.88_Fab Light Chain

SEQ ID NO: 31400 - protein, 111 aa, Artificial Sequence; identical to SEQ ID NO: 20571
  Description of Artificial Sequence: Synthetic polypeptide
  VL of XENP021165

SEQ ID NO: 31401 - protein, 15 aa, Artificial Sequence
  Description of Artificial Sequence: Synthetic peptide
  XENP021165 vlCDR1
KASQSVDYDGDSYMN

SEQ ID NO: 31402 - protein, 7 aa, Artificial Sequence
  Description of Artificial Sequence: Synthetic peptide
  XENP021165 vlCDR2
AASNLES

SEQ ID NO: 31403 - protein, 9 aa, Artificial Sequence
  Description of Artificial Sequence: Synthetic peptide
  XENP021165 vlCDR3
QQSLEDPFT

SEQ ID NO: 31404 - protein, 226 aa, Artificial Sequence; identical to SEQ ID NO: 29134
  Description of Artificial Sequence: Synthetic polypeptide
  XENP021166 7G8_H0_L0.89_Fab Heavy Chain

SEQ ID NO: 31405 - protein, 121 aa, Artificial Sequence; identical to SEQ ID NO: 17586
  Description of Artificial Sequence: Synthetic polypeptide
  VH of XENP021166

SEQ ID NO: 31406 - protein, 5 aa, Artificial Sequence
  Description of Artificial Sequence: Synthetic peptide
  XENP021166 vhCDR1
DAWMD

SEQ ID NO: 31407 - protein, 19 aa, Artificial Sequence
  Description of Artificial Sequence: Synthetic peptide
  XENP021166 vhCDR2
EIRTKANNHATYYAESVKG

SEQ ID NO: 31408 - protein, 10 aa, Artificial Sequence
  Description of Artificial Sequence: Synthetic peptide
  XENP021166 vhCDR3
LANWDWYFDV

SEQ ID NO: 31409 - protein, 218 aa, Artificial Sequence; identical to SEQ ID NO: 20580
  Description of Artificial Sequence: Synthetic polypeptide
  XENP021166 7G8_H0_L0.89_Fab Light Chain

SEQ ID NO: 31410 - protein, 111 aa, Artificial Sequence; identical to SEQ ID NO: 20581
  Description of Artificial Sequence: Synthetic polypeptide
  VL of XENP021166

SEQ ID NO: 31411 - protein, 15 aa, Artificial Sequence
  Description of Artificial Sequence: Synthetic peptide
  XENP021166 vlCDR1
KASQSVDYDGDSYMN

SEQ ID NO: 31412 - protein, 7 aa, Artificial Sequence
  Description of Artificial Sequence: Synthetic peptide
  XENP021166 vlCDR2
AASNLES

SEQ ID NO: 31413 - protein, 9 aa, Artificial Sequence
  Description of Artificial Sequence: Synthetic peptide
  XENP021166 vlCDR3
QQSTEDPFT

SEQ ID NO: 31414 - protein, 226 aa, Artificial Sequence; identical to SEQ ID NO: 29134
  Description of Artificial Sequence: Synthetic polypeptide
  XENP021167 7G8_H0_L0.90_Fab Heavy Chain

SEQ ID NO: 31415 - protein, 121 aa, Artificial Sequence; identical to SEQ ID NO: 17586
  Description of Artificial Sequence: Synthetic polypeptide
  VH of XENP021167

SEQ ID NO: 31416 - protein, 5 aa, Artificial Sequence
  Description of Artificial Sequence: Synthetic peptide
  XENP021167 vhCDR1
DAWMD

SEQ ID NO: 31417 - protein, 19 aa, Artificial Sequence
  Description of Artificial Sequence: Synthetic peptide
  XENP021167 vhCDR2
EIRTKANNHATYYAESVKG

SEQ ID NO: 31418 - protein, 10 aa, Artificial Sequence
  Description of Artificial Sequence: Synthetic peptide
  XENP021167 vhCDR3
LANWDWYFDV

SEQ ID NO: 31419 - protein, 218 aa, Artificial Sequence; identical to SEQ ID NO: 20590
  Description of Artificial Sequence: Synthetic polypeptide
  XENP021167 7G8_H0_L0.90_Fab Light Chain

SEQ ID NO: 31420 - protein, 111 aa, Artificial Sequence; identical to SEQ ID NO: 20591
  Description of Artificial Sequence: Synthetic polypeptide
  VL of XENP021167

SEQ ID NO: 31421 - protein, 15 aa, Artificial Sequence
  Description of Artificial Sequence: Synthetic peptide
  XENP021167 vlCDR1
KASQSVDYDGDSYMN

SEQ ID NO: 31422 - protein, 7 aa, Artificial Sequence
  Description of Artificial Sequence: Synthetic peptide
  XENP021167 vlCDR2
AASNLES

SEQ ID NO: 31423 - protein, 9 aa, Artificial Sequence
  Description of Artificial Sequence: Synthetic peptide
  XENP021167 vlCDR3
QQSGEDPFT

SEQ ID NO: 31424 - protein, 226 aa, Artificial Sequence; identical to SEQ ID NO: 29134
  Description of Artificial Sequence: Synthetic polypeptide
  XENP021168 7G8_H0_L0.91_Fab Heavy Chain

SEQ ID NO: 31425 - protein, 121 aa, Artificial Sequence; identical to SEQ ID NO: 17586
  Description of Artificial Sequence: Synthetic polypeptide
  VH of XENP021168

SEQ ID NO: 31426 - protein, 5 aa, Artificial Sequence
  Description of Artificial Sequence: Synthetic peptide
  XENP021168 vhCDR1
DAWMD

SEQ ID NO: 31427 - protein, 19 aa, Artificial Sequence
  Description of Artificial Sequence: Synthetic peptide
  XENP021168 vhCDR2
EIRTKANNHATYYAESVKG

SEQ ID NO: 31428 - protein, 10 aa, Artificial Sequence
  Description of Artificial Sequence: Synthetic peptide
  XENP021168 vhCDR3
LANWDWYFDV

SEQ ID NO: 31429 - protein, 218 aa, Artificial Sequence; identical to SEQ ID NO: 20600
  Description of Artificial Sequence: Synthetic polypeptide
  XENP021168 7G8_H0_L0.91_Fab Light Chain

SEQ ID NO: 31430 - protein, 111 aa, Artificial Sequence; identical to SEQ ID NO: 20601
  Description of Artificial Sequence: Synthetic polypeptide
  VL of XENP021168

SEQ ID NO: 31431 - protein, 15 aa, Artificial Sequence
  Description of Artificial Sequence: Synthetic peptide
  XENP021168 vlCDR1
KASQSVDYDGDSYMN

SEQ ID NO: 31432 - protein, 7 aa, Artificial Sequence
  Description of Artificial Sequence: Synthetic peptide
  XENP021168 vlCDR2
AASNLES

SEQ ID NO: 31433 - protein, 9 aa, Artificial Sequence
  Description of Artificial Sequence: Synthetic peptide
  XENP021168 vlCDR3
QQSYEDPFT

SEQ ID NO: 31434 - protein, 226 aa, Artificial Sequence; identical to SEQ ID NO: 29134
  Description of Artificial Sequence: Synthetic polypeptide
  XENP021169 7G8_H0_L0.92_Fab Heavy Chain

SEQ ID NO: 31435 - protein, 121 aa, Artificial Sequence; identical to SEQ ID NO: 17586
  Description of Artificial Sequence: Synthetic polypeptide
  VH of XENP021169

SEQ ID NO: 31436 - protein, 5 aa, Artificial Sequence
  Description of Artificial Sequence: Synthetic peptide
  XENP021169 vhCDR1
DAWMD

SEQ ID NO: 31437 - protein, 19 aa, Artificial Sequence
  Description of Artificial Sequence: Synthetic peptide
  XENP021169 vhCDR2
EIRTKANNHATYYAESVKG

SEQ ID NO: 31438 - protein, 10 aa, Artificial Sequence
  Description of Artificial Sequence: Synthetic peptide
  XENP021169 vhCDR3
LANWDWYFDV

SEQ ID NO: 31439 - protein, 218 aa, Artificial Sequence; identical to SEQ ID NO: 20610
  Description of Artificial Sequence: Synthetic polypeptide
  XENP021169 7G8_H0_L0.92_Fab Light Chain

SEQ ID NO: 31440 - protein, 111 aa, Artificial Sequence; identical to SEQ ID NO: 20611
  Description of Artificial Sequence: Synthetic polypeptide
  VL of XENP021169

SEQ ID NO: 31441 - protein, 15 aa, Artificial Sequence
  Description of Artificial Sequence: Synthetic peptide
  XENP021169 vlCDR1
KASQSVDYDGDSYMN

SEQ ID NO: 31442 - protein, 7 aa, Artificial Sequence
  Description of Artificial Sequence: Synthetic peptide
  XENP021169 vlCDR2
AASNLES

SEQ ID NO: 31443 - protein, 9 aa, Artificial Sequence
  Description of Artificial Sequence: Synthetic peptide
  XENP021169 vlCDR3
QQSNQDPFT

SEQ ID NO: 31444 - protein, 226 aa, Artificial Sequence; identical to SEQ ID NO: 29134
  Description of Artificial Sequence: Synthetic polypeptide
  XENP021170 7G8_H0_L0.93_Fab Heavy Chain

SEQ ID NO: 31445 - protein, 121 aa, Artificial Sequence; identical to SEQ ID NO: 17586
  Description of Artificial Sequence: Synthetic polypeptide
  VH of XENP021170

SEQ ID NO: 31446 - protein, 5 aa, Artificial Sequence
  Description of Artificial Sequence: Synthetic peptide
  XENP021170 vhCDR1
DAWMD

SEQ ID NO: 31447 - protein, 19 aa, Artificial Sequence
  Description of Artificial Sequence: Synthetic peptide
  XENP021170 vhCDR2
EIRTKANNHATYYAESVKG

SEQ ID NO: 31448 - protein, 10 aa, Artificial Sequence
  Description of Artificial Sequence: Synthetic peptide
  XENP021170 vhCDR3
LANWDWYFDV

SEQ ID NO: 31449 - protein, 218 aa, Artificial Sequence; identical to SEQ ID NO: 20620
  Description of Artificial Sequence: Synthetic polypeptide
  XENP021170 7G8_H0_L0.93_Fab Light Chain

SEQ ID NO: 31450 - protein, 111 aa, Artificial Sequence; identical to SEQ ID NO: 20621
  Description of Artificial Sequence: Synthetic polypeptide
  VL of XENP021170

SEQ ID NO: 31451 - protein, 15 aa, Artificial Sequence
  Description of Artificial Sequence: Synthetic peptide
  XENP021170 vlCDR1
KASQSVDYDGDSYMN

SEQ ID NO: 31452 - protein, 7 aa, Artificial Sequence
  Description of Artificial Sequence: Synthetic peptide
  XENP021170 vlCDR2
AASNLES

SEQ ID NO: 31453 - protein, 9 aa, Artificial Sequence
  Description of Artificial Sequence: Synthetic peptide
  XENP021170 vlCDR3
QQSNDDPFT

SEQ ID NO: 31454 - protein, 226 aa, Artificial Sequence; identical to SEQ ID NO: 29134
  Description of Artificial Sequence: Synthetic polypeptide
  XENP021171 7G8_H0_L0.94_Fab Heavy Chain

SEQ ID NO: 31455 - protein, 121 aa, Artificial Sequence; identical to SEQ ID NO: 17586
  Description of Artificial Sequence: Synthetic polypeptide
  VH of XENP021171

SEQ ID NO: 31456 - protein, 5 aa, Artificial Sequence
  Description of Artificial Sequence: Synthetic peptide
  XENP021171 vhCDR1
DAWMD

SEQ ID NO: 31457 - protein, 19 aa, Artificial Sequence
  Description of Artificial Sequence: Synthetic peptide
  XENP021171 vhCDR2
EIRTKANNHATYYAESVKG

SEQ ID NO: 31458 - protein, 10 aa, Artificial Sequence
  Description of Artificial Sequence: Synthetic peptide
  XENP021171 vhCDR3
LANWDWYFDV

SEQ ID NO: 31459 - protein, 218 aa, Artificial Sequence; identical to SEQ ID NO: 20630
  Description of Artificial Sequence: Synthetic polypeptide
  XENP021171 7G8_H0_L0.94_Fab Light Chain

SEQ ID NO: 31460 - protein, 111 aa, Artificial Sequence; identical to SEQ ID NO: 20631
  Description of Artificial Sequence: Synthetic polypeptide
  VL of XENP021171

SEQ ID NO: 31461 - protein, 15 aa, Artificial Sequence
  Description of Artificial Sequence: Synthetic peptide
  XENP021171 vlCDR1
KASQSVDYDGDSYMN

SEQ ID NO: 31462 - protein, 7 aa, Artificial Sequence
  Description of Artificial Sequence: Synthetic peptide
  XENP021171 vlCDR2
AASNLES

SEQ ID NO: 31463 - protein, 9 aa, Artificial Sequence
  Description of Artificial Sequence: Synthetic peptide
  XENP021171 vlCDR3
QQSNKDPFT

SEQ ID NO: 31464 - protein, 226 aa, Artificial Sequence; identical to SEQ ID NO: 29134
  Description of Artificial Sequence: Synthetic polypeptide
  XENP021172 7G8_H0_L0.95_Fab Heavy Chain

SEQ ID NO: 31465 - protein, 121 aa, Artificial Sequence; identical to SEQ ID NO: 17586
  Description of Artificial Sequence: Synthetic polypeptide
  VH of XENP021172

SEQ ID NO: 31466 - protein, 5 aa, Artificial Sequence
  Description of Artificial Sequence: Synthetic peptide
  XENP021172 vhCDR1
DAWMD

SEQ ID NO: 31467 - protein, 19 aa, Artificial Sequence
  Description of Artificial Sequence: Synthetic peptide
  XENP021172 vhCDR2
EIRTKANNHATYYAESVKG

SEQ ID NO: 31468 - protein, 10 aa, Artificial Sequence
  Description of Artificial Sequence: Synthetic peptide
  XENP021172 vhCDR3
LANWDWYFDV

SEQ ID NO: 31469 - protein, 218 aa, Artificial Sequence; identical to SEQ ID NO: 20640
  Description of Artificial Sequence: Synthetic polypeptide
  XENP021172 7G8_H0_L0.95_Fab Light Chain

SEQ ID NO: 31470 - protein, 111 aa, Artificial Sequence; identical to SEQ ID NO: 20641
  Description of Artificial Sequence: Synthetic polypeptide
  VL of XENP021172

SEQ ID NO: 31471 - protein, 15 aa, Artificial Sequence
  Description of Artificial Sequence: Synthetic peptide
  XENP021172 vlCDR1
KASQSVDYDGDSYMN

SEQ ID NO: 31472 - protein, 7 aa, Artificial Sequence
  Description of Artificial Sequence: Synthetic peptide
  XENP021172 vlCDR2
AASNLES

SEQ ID NO: 31473 - protein, 9 aa, Artificial Sequence
  Description of Artificial Sequence: Synthetic peptide
  XENP021172 vlCDR3
QQSNSDPFT

SEQ ID NO: 31474 - protein, 226 aa, Artificial Sequence; identical to SEQ ID NO: 29134
  Description of Artificial Sequence: Synthetic polypeptide
  XENP021173 7G8_H0_L0.96_Fab Heavy Chain

SEQ ID NO: 31475 - protein, 121 aa, Artificial Sequence; identical to SEQ ID NO: 17586
  Description of Artificial Sequence: Synthetic polypeptide
  VH of XENP021173

SEQ ID NO: 31476 - protein, 5 aa, Artificial Sequence
  Description of Artificial Sequence: Synthetic peptide
  XENP021173 vhCDR1
DAWMD

SEQ ID NO: 31477 - protein, 19 aa, Artificial Sequence
  Description of Artificial Sequence: Synthetic peptide
  XENP021173 vhCDR2
EIRTKANNHATYYAESVKG

SEQ ID NO: 31478 - protein, 10 aa, Artificial Sequence
  Description of Artificial Sequence: Synthetic peptide
  XENP021173 vhCDR3
LANWDWYFDV

SEQ ID NO: 31479 - protein, 218 aa, Artificial Sequence; identical to SEQ ID NO: 20650
  Description of Artificial Sequence: Synthetic polypeptide
  XENP021173 7G8_H0_L0.96_Fab Light Chain

SEQ ID NO: 31480 - protein, 111 aa, Artificial Sequence; identical to SEQ ID NO: 20651
  Description of Artificial Sequence: Synthetic polypeptide
  VL of XENP021173

SEQ ID NO: 31481 - protein, 15 aa, Artificial Sequence
  Description of Artificial Sequence: Synthetic peptide
  XENP021173 vlCDR1
KASQSVDYDGDSYMN

SEQ ID NO: 31482 - protein, 7 aa, Artificial Sequence
  Description of Artificial Sequence: Synthetic peptide
  XENP021173 vlCDR2
AASNLES

SEQ ID NO: 31483 - protein, 9 aa, Artificial Sequence
  Description of Artificial Sequence: Synthetic peptide
  XENP021173 vlCDR3
QQSNHDPFT

SEQ ID NO: 31484 - protein, 226 aa, Artificial Sequence; identical to SEQ ID NO: 29134
  Description of Artificial Sequence: Synthetic polypeptide
  XENP021174 7G8_H0_L0.97_Fab Heavy Chain

SEQ ID NO: 31485 - protein, 121 aa, Artificial Sequence; identical to SEQ ID NO: 17586
  Description of Artificial Sequence: Synthetic polypeptide
  VH of XENP021174

SEQ ID NO: 31486 - protein, 5 aa, Artificial Sequence
  Description of Artificial Sequence: Synthetic peptide
  XENP021174 vhCDR1
DAWMD

SEQ ID NO: 31487 - protein, 19 aa, Artificial Sequence
  Description of Artificial Sequence: Synthetic peptide
  XENP021174 vhCDR2
EIRTKANNHATYYAESVKG

SEQ ID NO: 31488 - protein, 10 aa, Artificial Sequence
  Description of Artificial Sequence: Synthetic peptide
  XENP021174 vhCDR3
LANWDWYFDV

SEQ ID NO: 31489 - protein, 218 aa, Artificial Sequence; identical to SEQ ID NO: 20660
  Description of Artificial Sequence: Synthetic polypeptide
  XENP021174 7G8_H0_L0.97_Fab Light Chain

SEQ ID NO: 31490 - protein, 111 aa, Artificial Sequence; identical to SEQ ID NO: 20661
  Description of Artificial Sequence: Synthetic polypeptide
  VL of XENP021174

SEQ ID NO: 31491 - protein, 15 aa, Artificial Sequence
  Description of Artificial Sequence: Synthetic peptide
  XENP021174 vlCDR1
KASQSVDYDGDSYMN

SEQ ID NO: 31492 - protein, 7 aa, Artificial Sequence
  Description of Artificial Sequence: Synthetic peptide
  XENP021174 vlCDR2
AASNLES

SEQ ID NO: 31493 - protein, 9 aa, Artificial Sequence
  Description of Artificial Sequence: Synthetic peptide
  XENP021174 vlCDR3
QQSNADPFT

SEQ ID NO: 31494 - protein, 226 aa, Artificial Sequence; identical to SEQ ID NO: 29134
  Description of Artificial Sequence: Synthetic polypeptide
  XENP021175 7G8_H0_L0.98_Fab Heavy Chain

SEQ ID NO: 31495 - protein, 121 aa, Artificial Sequence; identical to SEQ ID NO: 17586
  Description of Artificial Sequence: Synthetic polypeptide
  VH of XENP021175

SEQ ID NO: 31496 - protein, 5 aa, Artificial Sequence
  Description of Artificial Sequence: Synthetic peptide
  XENP021175 vhCDR1
DAWMD

SEQ ID NO: 31497 - protein, 19 aa, Artificial Sequence
  Description of Artificial Sequence: Synthetic peptide
  XENP021175 vhCDR2
EIRTKANNHATYYAESVKG

SEQ ID NO: 31498 - protein, 10 aa, Artificial Sequence
  Description of Artificial Sequence: Synthetic peptide
  XENP021175 vhCDR3
LANWDWYFDV

SEQ ID NO: 31499 - protein, 218 aa, Artificial Sequence; identical to SEQ ID NO: 20670
  Description of Artificial Sequence: Synthetic polypeptide
  XENP021175 7G8_H0_L0.98_Fab Light Chain

SEQ ID NO: 31500 - protein, 111 aa, Artificial Sequence; identical to SEQ ID NO: 20671
  Description of Artificial Sequence: Synthetic polypeptide
  VL of XENP021175

SEQ ID NO: 31501 - protein, 15 aa, Artificial Sequence
  Description of Artificial Sequence: Synthetic peptide
  XENP021175 vlCDR1
KASQSVDYDGDSYMN

SEQ ID NO: 31502 - protein, 7 aa, Artificial Sequence
  Description of Artificial Sequence: Synthetic peptide
  XENP021175 vlCDR2
AASNLES

SEQ ID NO: 31503 - protein, 9 aa, Artificial Sequence
  Description of Artificial Sequence: Synthetic peptide
  XENP021175 vlCDR3
QQSNGDPFT

SEQ ID NO: 31504 - protein, 226 aa, Artificial Sequence; identical to SEQ ID NO: 29134
  Description of Artificial Sequence: Synthetic polypeptide
  XENP021176 7G8_H0_L0.99_Fab Heavy Chain

SEQ ID NO: 31505 - protein, 121 aa, Artificial Sequence; identical to SEQ ID NO: 17586
  Description of Artificial Sequence: Synthetic polypeptide
  VH of XENP021176

SEQ ID NO: 31506 - protein, 5 aa, Artificial Sequence
  Description of Artificial Sequence: Synthetic peptide
  XENP021176 vhCDR1
DAWMD

SEQ ID NO: 31507 - protein, 19 aa, Artificial Sequence
  Description of Artificial Sequence: Synthetic peptide
  XENP021176 vhCDR2
EIRTKANNHATYYAESVKG

SEQ ID NO: 31508 - protein, 10 aa, Artificial Sequence
  Description of Artificial Sequence: Synthetic peptide
  XENP021176 vhCDR3
LANWDWYFDV

SEQ ID NO: 31509 - protein, 218 aa, Artificial Sequence; identical to SEQ ID NO: 20680
  Description of Artificial Sequence: Synthetic polypeptide
  XENP021176 7G8_H0_L0.99_Fab Light Chain

SEQ ID NO: 31510 - protein, 111 aa, Artificial Sequence; identical to SEQ ID NO: 20681
  Description of Artificial Sequence: Synthetic polypeptide
  VL of XENP021176

SEQ ID NO: 31511 - protein, 15 aa, Artificial Sequence
  Description of Artificial Sequence: Synthetic peptide
  XENP021176 vlCDR1
KASQSVDYDGDSYMN

SEQ ID NO: 31512 - protein, 7 aa, Artificial Sequence
  Description of Artificial Sequence: Synthetic peptide
  XENP021176 vlCDR2
AASNLES

SEQ ID NO: 31513 - protein, 9 aa, Artificial Sequence
  Description of Artificial Sequence: Synthetic peptide
  XENP021176 vlCDR3
QQSNYDPFT

SEQ ID NO: 31514 - protein, 226 aa, Artificial Sequence; identical to SEQ ID NO: 29134
  Description of Artificial Sequence: Synthetic polypeptide
  XENP021177 7G8_H0_L0.100_Fab Heavy Chain

SEQ ID NO: 31515 - protein, 121 aa, Artificial Sequence; identical to SEQ ID NO: 17586
  Description of Artificial Sequence: Synthetic polypeptide
  VH of XENP021177

SEQ ID NO: 31516 - protein, 5 aa, Artificial Sequence
  Description of Artificial Sequence: Synthetic peptide
  XENP021177 vhCDR1
DAWMD

SEQ ID NO: 31517 - protein, 19 aa, Artificial Sequence
  Description of Artificial Sequence: Synthetic peptide
  XENP021177 vhCDR2
EIRTKANNHATYYAESVKG

SEQ ID NO: 31518 - protein, 10 aa, Artificial Sequence
  Description of Artificial Sequence: Synthetic peptide
  XENP021177 vhCDR3
LANWDWYFDV

SEQ ID NO: 31519 - protein, 218 aa, Artificial Sequence; identical to SEQ ID NO: 20690
  Description of Artificial Sequence: Synthetic polypeptide
  XENP021177 7G8_H0_L0.100_Fab Light Chain

SEQ ID NO: 31520 - protein, 111 aa, Artificial Sequence; identical to SEQ ID NO: 20691
  Description of Artificial Sequence: Synthetic polypeptide
  VL of XENP021177

SEQ ID NO: 31521 - protein, 15 aa, Artificial Sequence
  Description of Artificial Sequence: Synthetic peptide
  XENP021177 vlCDR1
KASQSVDYDGDSYMN

SEQ ID NO: 31522 - protein, 7 aa, Artificial Sequence
  Description of Artificial Sequence: Synthetic peptide
  XENP021177 vlCDR2
AASNLES

SEQ ID NO: 31523 - protein, 9 aa, Artificial Sequence
  Description of Artificial Sequence: Synthetic peptide
  XENP021177 vlCDR3
QQSNIDPFT

SEQ ID NO: 31524 - protein, 226 aa, Artificial Sequence; identical to SEQ ID NO: 29134
  Description of Artificial Sequence: Synthetic polypeptide
  XENP021178 7G8_H0_L0.101_Fab Heavy Chain

SEQ ID NO: 31525 - protein, 121 aa, Artificial Sequence; identical to SEQ ID NO: 17586
  Description of Artificial Sequence: Synthetic polypeptide
  VH of XENP021178

SEQ ID NO: 31526 - protein, 5 aa, Artificial Sequence
  Description of Artificial Sequence: Synthetic peptide
  XENP021178 vhCDR1
DAWMD

SEQ ID NO: 31527 - protein, 19 aa, Artificial Sequence
  Description of Artificial Sequence: Synthetic peptide
  XENP021178 vhCDR2
EIRTKANNHATYYAESVKG

SEQ ID NO: 31528 - protein, 10 aa, Artificial Sequence
  Description of Artificial Sequence: Synthetic peptide
  XENP021178 vhCDR3
LANWDWYFDV

SEQ ID NO: 31529 - protein, 218 aa, Artificial Sequence; identical to SEQ ID NO: 20700
  Description of Artificial Sequence: Synthetic polypeptide
  XENP021178 7G8_H0_L0.101_Fab Light Chain

SEQ ID NO: 31530 - protein, 111 aa, Artificial Sequence; identical to SEQ ID NO: 20701
  Description of Artificial Sequence: Synthetic polypeptide
  VL of XENP021178

SEQ ID NO: 31531 - protein, 15 aa, Artificial Sequence
  Description of Artificial Sequence: Synthetic peptide
  XENP021178 vlCDR1
KASQSVDYDGDSYMN

SEQ ID NO: 31532 - protein, 7 aa, Artificial Sequence
  Description of Artificial Sequence: Synthetic peptide
  XENP021178 vlCDR2
AASNLES

SEQ ID NO: 31533 - protein, 9 aa, Artificial Sequence
  Description of Artificial Sequence: Synthetic peptide
  XENP021178 vlCDR3
QQSNENPFT

SEQ ID NO: 31534 - protein, 226 aa, Artificial Sequence; identical to SEQ ID NO: 29134
  Description of Artificial Sequence: Synthetic polypeptide
  XENP021179 7G8_H0_L0.102_Fab Heavy Chain

SEQ ID NO: 31535 - protein, 121 aa, Artificial Sequence; identical to SEQ ID NO: 17586
  Description of Artificial Sequence: Synthetic polypeptide
  VH of XENP021179

SEQ ID NO: 31536 - protein, 5 aa, Artificial Sequence
  Description of Artificial Sequence: Synthetic peptide
  XENP021179 vhCDR1
DAWMD

SEQ ID NO: 31537 - protein, 19 aa, Artificial Sequence
  Description of Artificial Sequence: Synthetic peptide
  XENP021179 vhCDR2
EIRTKANNHATYYAESVKG

SEQ ID NO: 31538 - protein, 10 aa, Artificial Sequence
  Description of Artificial Sequence: Synthetic peptide
  XENP021179 vhCDR3
LANWDWYFDV

SEQ ID NO: 31539 - protein, 218 aa, Artificial Sequence; identical to SEQ ID NO: 20710
  Description of Artificial Sequence: Synthetic polypeptide
  XENP021179 7G8_H0_L0.102_Fab Light Chain

SEQ ID NO: 31540 - protein, 111 aa, Artificial Sequence; identical to SEQ ID NO: 20711
  Description of Artificial Sequence: Synthetic polypeptide
  VL of XENP021179

SEQ ID NO: 31541 - protein, 15 aa, Artificial Sequence
  Description of Artificial Sequence: Synthetic peptide
  XENP021179 vlCDR1
KASQSVDYDGDSYMN

SEQ ID NO: 31542 - protein, 7 aa, Artificial Sequence
  Description of Artificial Sequence: Synthetic peptide
  XENP021179 vlCDR2
AASNLES

SEQ ID NO: 31543 - protein, 9 aa, Artificial Sequence
  Description of Artificial Sequence: Synthetic peptide
  XENP021179 vlCDR3
QQSNEEPFT

SEQ ID NO: 31544 - protein, 226 aa, Artificial Sequence; identical to SEQ ID NO: 29134
  Description of Artificial Sequence: Synthetic polypeptide
  XENP021180 7G8_H0_L0.103_Fab Heavy Chain

SEQ ID NO: 31545 - protein, 121 aa, Artificial Sequence; identical to SEQ ID NO: 17586
  Description of Artificial Sequence: Synthetic polypeptide
  VH of XENP021180

SEQ ID NO: 31546 - protein, 5 aa, Artificial Sequence
  Description of Artificial Sequence: Synthetic peptide
  XENP021180 vhCDR1
DAWMD

SEQ ID NO: 31547 - protein, 19 aa, Artificial Sequence
  Description of Artificial Sequence: Synthetic peptide
  XENP021180 vhCDR2
EIRTKANNHATYYAESVKG

SEQ ID NO: 31548 - protein, 10 aa, Artificial Sequence
  Description of Artificial Sequence: Synthetic peptide
  XENP021180 vhCDR3
LANWDWYFDV

SEQ ID NO: 31549 - protein, 218 aa, Artificial Sequence; identical to SEQ ID NO: 20720
  Description of Artificial Sequence: Synthetic polypeptide
  XENP021180 7G8_H0_L0.103_Fab Light Chain

SEQ ID NO: 31550 - protein, 111 aa, Artificial Sequence; identical to SEQ ID NO: 20721
  Description of Artificial Sequence: Synthetic polypeptide
  VL of XENP021180

SEQ ID NO: 31551 - protein, 15 aa, Artificial Sequence
  Description of Artificial Sequence: Synthetic peptide
  XENP021180 vlCDR1
KASQSVDYDGDSYMN

SEQ ID NO: 31552 - protein, 7 aa, Artificial Sequence
  Description of Artificial Sequence: Synthetic peptide
  XENP021180 vlCDR2
AASNLES

SEQ ID NO: 31553 - protein, 9 aa, Artificial Sequence
  Description of Artificial Sequence: Synthetic peptide
  XENP021180 vlCDR3
QQSNEHPFT

SEQ ID NO: 31554 - protein, 226 aa, Artificial Sequence; identical to SEQ ID NO: 29134
  Description of Artificial Sequence: Synthetic polypeptide
  XENP021181 7G8_H0_L0.104_Fab Heavy Chain

SEQ ID NO: 31555 - protein, 121 aa, Artificial Sequence; identical to SEQ ID NO: 17586
  Description of Artificial Sequence: Synthetic polypeptide
  VH of XENP021181

SEQ ID NO: 31556 - protein, 5 aa, Artificial Sequence
  Description of Artificial Sequence: Synthetic peptide
  XENP021181 vhCDR1
DAWMD

SEQ ID NO: 31557 - protein, 19 aa, Artificial Sequence
  Description of Artificial Sequence: Synthetic peptide
  XENP021181 vhCDR2
EIRTKANNHATYYAESVKG

SEQ ID NO: 31558 - protein, 10 aa, Artificial Sequence
  Description of Artificial Sequence: Synthetic peptide
  XENP021181 vhCDR3
LANWDWYFDV

SEQ ID NO: 31559 - protein, 218 aa, Artificial Sequence; identical to SEQ ID NO: 20730
  Description of Artificial Sequence: Synthetic polypeptide
  XENP021181 7G8_H0_L0.104_Fab Light Chain

SEQ ID NO: 31560 - protein, 111 aa, Artificial Sequence; identical to SEQ ID NO: 20731
  Description of Artificial Sequence: Synthetic polypeptide
  VL of XENP021181

SEQ ID NO: 31561 - protein, 15 aa, Artificial Sequence
  Description of Artificial Sequence: Synthetic peptide
  XENP021181 vlCDR1
KASQSVDYDGDSYMN

SEQ ID NO: 31562 - protein, 7 aa, Artificial Sequence
  Description of Artificial Sequence: Synthetic peptide
  XENP021181 vlCDR2
AASNLES

SEQ ID NO: 31563 - protein, 9 aa, Artificial Sequence
  Description of Artificial Sequence: Synthetic peptide
  XENP021181 vlCDR3
QQSNERPFT

SEQ ID NO: 31564 - protein, 226 aa, Artificial Sequence; identical to SEQ ID NO: 29134
  Description of Artificial Sequence: Synthetic polypeptide
  XENP021182 7G8_H0_L0.105_Fab Heavy Chain

SEQ ID NO: 31565 - protein, 121 aa, Artificial Sequence; identical to SEQ ID NO: 17586
  Description of Artificial Sequence: Synthetic polypeptide
  VH of XENP021182

SEQ ID NO: 31566 - protein, 5 aa, Artificial Sequence
  Description of Artificial Sequence: Synthetic peptide
  XENP021182 vhCDR1
DAWMD

SEQ ID NO: 31567 - protein, 19 aa, Artificial Sequence
  Description of Artificial Sequence: Synthetic peptide
  XENP021182 vhCDR2
EIRTKANNHATYYAESVKG

SEQ ID NO: 31568 - protein, 10 aa, Artificial Sequence
  Description of Artificial Sequence: Synthetic peptide
  XENP021182 vhCDR3
LANWDWYFDV

SEQ ID NO: 31569 - protein, 218 aa, Artificial Sequence; identical to SEQ ID NO: 20740
  Description of Artificial Sequence: Synthetic polypeptide
  XENP021182 7G8_H0_L0.105_Fab Light Chain

SEQ ID NO: 31570 - protein, 111 aa, Artificial Sequence; identical to SEQ ID NO: 20741
  Description of Artificial Sequence: Synthetic polypeptide
  VL of XENP021182

SEQ ID NO: 31571 - protein, 15 aa, Artificial Sequence
  Description of Artificial Sequence: Synthetic peptide
  XENP021182 vlCDR1
KASQSVDYDGDSYMN

SEQ ID NO: 31572 - protein, 7 aa, Artificial Sequence
  Description of Artificial Sequence: Synthetic peptide
  XENP021182 vlCDR2
AASNLES

SEQ ID NO: 31573 - protein, 9 aa, Artificial Sequence
  Description of Artificial Sequence: Synthetic peptide
  XENP021182 vlCDR3
QQSNELPFT

SEQ ID NO: 31574 - protein, 226 aa, Artificial Sequence; identical to SEQ ID NO: 29134
  Description of Artificial Sequence: Synthetic polypeptide
  XENP021183 7G8_H0_L0.106_Fab Heavy Chain

SEQ ID NO: 31575 - protein, 121 aa, Artificial Sequence; identical to SEQ ID NO: 17586
  Description of Artificial Sequence: Synthetic polypeptide
  VH of XENP021183

SEQ ID NO: 31576 - protein, 5 aa, Artificial Sequence
  Description of Artificial Sequence: Synthetic peptide
  XENP021183 vhCDR1
DAWMD

SEQ ID NO: 31577 - protein, 19 aa, Artificial Sequence
  Description of Artificial Sequence: Synthetic peptide
  XENP021183 vhCDR2
EIRTKANNHATYYAESVKG

SEQ ID NO: 31578 - protein, 10 aa, Artificial Sequence
  Description of Artificial Sequence: Synthetic peptide
  XENP021183 vhCDR3
LANWDWYFDV

SEQ ID NO: 31579 - protein, 218 aa, Artificial Sequence; identical to SEQ ID NO: 20750
  Description of Artificial Sequence: Synthetic polypeptide
  XENP021183 7G8_H0_L0.106_Fab Light Chain

SEQ ID NO: 31580 - protein, 111 aa, Artificial Sequence; identical to SEQ ID NO: 20751
  Description of Artificial Sequence: Synthetic polypeptide
  VL of XENP021183

SEQ ID NO: 31581 - protein, 15 aa, Artificial Sequence
  Description of Artificial Sequence: Synthetic peptide
  XENP021183 vlCDR1
KASQSVDYDGDSYMN

SEQ ID NO: 31582 - protein, 7 aa, Artificial Sequence
  Description of Artificial Sequence: Synthetic peptide
  XENP021183 vlCDR2
AASNLES

SEQ ID NO: 31583 - protein, 9 aa, Artificial Sequence
  Description of Artificial Sequence: Synthetic peptide
  XENP021183 vlCDR3
QQSNEGPFT

SEQ ID NO: 31584 - protein, 226 aa, Artificial Sequence; identical to SEQ ID NO: 29134
  Description of Artificial Sequence: Synthetic polypeptide
  XENP021184 7G8_H0_L0.107_Fab Heavy Chain

SEQ ID NO: 31585 - protein, 121 aa, Artificial Sequence; identical to SEQ ID NO: 17586
  Description of Artificial Sequence: Synthetic polypeptide
  VH of XENP021184

SEQ ID NO: 31586 - protein, 5 aa, Artificial Sequence
  Description of Artificial Sequence: Synthetic peptide
  XENP021184 vhCDR1
DAWMD

SEQ ID NO: 31587 - protein, 19 aa, Artificial Sequence
  Description of Artificial Sequence: Synthetic peptide
  XENP021184 vhCDR2
EIRTKANNHATYYAESVKG

SEQ ID NO: 31588 - protein, 10 aa, Artificial Sequence
  Description of Artificial Sequence: Synthetic peptide
  XENP021184 vhCDR3
LANWDWYFDV

SEQ ID NO: 31589 - protein, 218 aa, Artificial Sequence; identical to SEQ ID NO: 20760
  Description of Artificial Sequence: Synthetic polypeptide
  XENP021184 7G8_H0_L0.107_Fab Light Chain

SEQ ID NO: 31590 - protein, 111 aa, Artificial Sequence; identical to SEQ ID NO: 20761
  Description of Artificial Sequence: Synthetic polypeptide
  VL of XENP021184

SEQ ID NO: 31591 - protein, 15 aa, Artificial Sequence
  Description of Artificial Sequence: Synthetic peptide
  XENP021184 vlCDR1
KASQSVDYDGDSYMN

SEQ ID NO: 31592 - protein, 7 aa, Artificial Sequence
  Description of Artificial Sequence: Synthetic peptide
  XENP021184 vlCDR2
AASNLES

SEQ ID NO: 31593 - protein, 9 aa, Artificial Sequence
  Description of Artificial Sequence: Synthetic peptide
  XENP021184 vlCDR3
QQSNEYPFT

SEQ ID NO: 31594 - protein, 226 aa, Artificial Sequence; identical to SEQ ID NO: 28944
  Description of Artificial Sequence: Synthetic polypeptide
  XENP021558 7G8_H3.1_L0.59_Fab Heavy Chain

SEQ ID NO: 31595 - protein, 121 aa, Artificial Sequence; identical to SEQ ID NO: 28945
  Description of Artificial Sequence: Synthetic polypeptide
  VH of XENP021558

SEQ ID NO: 31596 - protein, 5 aa, Artificial Sequence
  Description of Artificial Sequence: Synthetic peptide
  XENP021558 vhCDR1
DAWMD

SEQ ID NO: 31597 - protein, 19 aa, Artificial Sequence
  Description of Artificial Sequence: Synthetic peptide
  XENP021558 vhCDR2
EIRTKANNHATYYAESVKG

SEQ ID NO: 31598 - protein, 10 aa, Artificial Sequence
  Description of Artificial Sequence: Synthetic peptide
  XENP021558 vhCDR3
LATWDWYFDV

SEQ ID NO: 31599 - protein, 218 aa, Artificial Sequence; identical to SEQ ID NO: 20280
  Description of Artificial Sequence: Synthetic polypeptide
  XENP021558 7G8_H3.1_L0.59_Fab Light Chain

SEQ ID NO: 31600 - protein, 111 aa, Artificial Sequence; identical to SEQ ID NO: 20281
  Description of Artificial Sequence: Synthetic polypeptide
  VL of XENP021558

SEQ ID NO: 31601 - protein, 15 aa, Artificial Sequence
  Description of Artificial Sequence: Synthetic peptide
  XENP021558 vlCDR1
KASQSVDYDGDSYMN

SEQ ID NO: 31602 - protein, 7 aa, Artificial Sequence
  Description of Artificial Sequence: Synthetic peptide
  XENP021558 vlCDR2
AASELES

SEQ ID NO: 31603 - protein, 9 aa, Artificial Sequence
  Description of Artificial Sequence: Synthetic peptide
  XENP021558 vlCDR3
QQSNEDPFT

SEQ ID NO: 31604 - protein, 226 aa, Artificial Sequence; identical to SEQ ID NO: 28974
  Description of Artificial Sequence: Synthetic polypeptide
  XENP021559 7G8_H3.4_L0.59_Fab Heavy Chain

SEQ ID NO: 31605 - protein, 121 aa, Artificial Sequence; identical to SEQ ID NO: 28975
  Description of Artificial Sequence: Synthetic polypeptide
  VH of XENP021559

SEQ ID NO: 31606 - protein, 5 aa, Artificial Sequence
  Description of Artificial Sequence: Synthetic peptide
  XENP021559 vhCDR1
DAWMD

SEQ ID NO: 31607 - protein, 19 aa, Artificial Sequence
  Description of Artificial Sequence: Synthetic peptide
  XENP021559 vhCDR2
EIRTKANNHATYYAESVKG

SEQ ID NO: 31608 - protein, 10 aa, Artificial Sequence
  Description of Artificial Sequence: Synthetic peptide
  XENP021559 vhCDR3
LATWDWYFDV

SEQ ID NO: 31609 - protein, 218 aa, Artificial Sequence; identical to SEQ ID NO: 20280
  Description of Artificial Sequence: Synthetic polypeptide
  XENP021559 7G8_H3.4_L0.59_Fab Light Chain

SEQ ID NO: 31610 - protein, 111 aa, Artificial Sequence; identical to SEQ ID NO: 20281
  Description of Artificial Sequence: Synthetic polypeptide
  VL of XENP021559

SEQ ID NO: 31611 - protein, 15 aa, Artificial Sequence
  Description of Artificial Sequence: Synthetic peptide
  XENP021559 vlCDR1
KASQSVDYDGDSYMN

SEQ ID NO: 31612 - protein, 7 aa, Artificial Sequence
  Description of Artificial Sequence: Synthetic peptide
  XENP021559 vlCDR2
AASELES

SEQ ID NO: 31613 - protein, 9 aa, Artificial Sequence
  Description of Artificial Sequence: Synthetic peptide
  XENP021559 vlCDR3
QQSNEDPFT

SEQ ID NO: 31614 - protein, 226 aa, Artificial Sequence; identical to SEQ ID NO: 30404
  Description of Artificial Sequence: Synthetic polypeptide
  XENP021560 7G8_H0.129_L0.59_Fab Heavy Chain

SEQ ID NO: 31615 - protein, 121 aa, Artificial Sequence; identical to SEQ ID NO: 19496
  Description of Artificial Sequence: Synthetic polypeptide
  VH of XENP021560

SEQ ID NO: 31616 - protein, 5 aa, Artificial Sequence
  Description of Artificial Sequence: Synthetic peptide
  XENP021560 vhCDR1
DAWMD

SEQ ID NO: 31617 - protein, 19 aa, Artificial Sequence
  Description of Artificial Sequence: Synthetic peptide
  XENP021560 vhCDR2
EIRTKANNHATYYAESVKG

SEQ ID NO: 31618 - protein, 10 aa, Artificial Sequence
  Description of Artificial Sequence: Synthetic peptide
  XENP021560 vhCDR3
LATWDWYFDV

SEQ ID NO: 31619 - protein, 218 aa, Artificial Sequence; identical to SEQ ID NO: 20280
  Description of Artificial Sequence: Synthetic polypeptide
  XENP021560 7G8_H0.129_L0.59_Fab Light Chain

SEQ ID NO: 31620 - protein, 111 aa, Artificial Sequence; identical to SEQ ID NO: 20281
  Description of Artificial Sequence: Synthetic polypeptide
  VL of XENP021560

SEQ ID NO: 31621 - protein, 15 aa, Artificial Sequence
  Description of Artificial Sequence: Synthetic peptide
  XENP021560 vlCDR1
KASQSVDYDGDSYMN

SEQ ID NO: 31622 - protein, 7 aa, Artificial Sequence
  Description of Artificial Sequence: Synthetic peptide
  XENP021560 vlCDR2
AASELES

SEQ ID NO: 31623 - protein, 9 aa, Artificial Sequence
  Description of Artificial Sequence: Synthetic peptide
  XENP021560 vlCDR3
QQSNEDPFT

SEQ ID NO: 31624 - protein, 226 aa, Artificial Sequence; identical to SEQ ID NO: 29454
  Description of Artificial Sequence: Synthetic polypeptide
  XENP021561 7G8_H0.31_L0.59_Fab Heavy Chain

SEQ ID NO: 31625 - protein, 121 aa, Artificial Sequence; identical to SEQ ID NO: 18516
  Description of Artificial Sequence: Synthetic polypeptide
  VH of XENP021561

SEQ ID NO: 31626 - protein, 5 aa, Artificial Sequence
  Description of Artificial Sequence: Synthetic peptide
  XENP021561 vhCDR1
DAWMD

SEQ ID NO: 31627 - protein, 19 aa, Artificial Sequence
  Description of Artificial Sequence: Synthetic peptide
  XENP021561 vhCDR2
EISTKANNHATYYAESVKG

SEQ ID NO: 31628 - protein, 10 aa, Artificial Sequence
  Description of Artificial Sequence: Synthetic peptide
  XENP021561 vhCDR3
LANWDWYFDV

SEQ ID NO: 31629 - protein, 218 aa, Artificial Sequence; identical to SEQ ID NO: 20280
  Description of Artificial Sequence: Synthetic polypeptide
  XENP021561 7G8_H0.31_L0.59_Fab Light Chain

SEQ ID NO: 31630 - protein, 111 aa, Artificial Sequence; identical to SEQ ID NO: 20281
  Description of Artificial Sequence: Synthetic polypeptide
  VL of XENP021561

SEQ ID NO: 31631 - protein, 15 aa, Artificial Sequence
  Description of Artificial Sequence: Synthetic peptide
  XENP021561 vlCDR1
KASQSVDYDGDSYMN

SEQ ID NO: 31632 - protein, 7 aa, Artificial Sequence
  Description of Artificial Sequence: Synthetic peptide
  XENP021561 vlCDR2
AASELES

SEQ ID NO: 31633 - protein, 9 aa, Artificial Sequence
  Description of Artificial Sequence: Synthetic peptide
  XENP021561 vlCDR3
QQSNEDPFT

SEQ ID NO: 31634 - protein, 226 aa, Artificial Sequence; identical to SEQ ID NO: 30174
  Description of Artificial Sequence: Synthetic polypeptide
  XENP021562 7G8_H0.103_L0.59_Fab Heavy Chain

SEQ ID NO: 31635 - protein, 121 aa, Artificial Sequence; identical to SEQ ID NO: 19236
  Description of Artificial Sequence: Synthetic polypeptide
  VH of XENP021562

SEQ ID NO: 31636 - protein, 5 aa, Artificial Sequence
  Description of Artificial Sequence: Synthetic peptide
  XENP021562 vhCDR1
DAWMD

SEQ ID NO: 31637 - protein, 19 aa, Artificial Sequence
  Description of Artificial Sequence: Synthetic peptide
  XENP021562 vhCDR2
EIRTKANNHATDYAESVKG

SEQ ID NO: 31638 - protein, 10 aa, Artificial Sequence
  Description of Artificial Sequence: Synthetic peptide
  XENP021562 vhCDR3
LANWDWYFDV

SEQ ID NO: 31639 - protein, 218 aa, Artificial Sequence; identical to SEQ ID NO: 20280
  Description of Artificial Sequence: Synthetic polypeptide
  XENP021562 7G8_H0.103_L0.59_Fab Light Chain

SEQ ID NO: 31640 - protein, 111 aa, Artificial Sequence; identical to SEQ ID NO: 20281
  Description of Artificial Sequence: Synthetic polypeptide
  VL of XENP021562

SEQ ID NO: 31641 - protein, 15 aa, Artificial Sequence
  Description of Artificial Sequence: Synthetic peptide
  XENP021562 vlCDR1
KASQSVDYDGDSYMN

SEQ ID NO: 31642 - protein, 7 aa, Artificial Sequence
  Description of Artificial Sequence: Synthetic peptide
  XENP021562 vlCDR2
AASELES

SEQ ID NO: 31643 - protein, 9 aa, Artificial Sequence
  Description of Artificial Sequence: Synthetic peptide
  XENP021562 vlCDR3
QQSNEDPFT

SEQ ID NO: 31644 - protein, 226 aa, Artificial Sequence; identical to SEQ ID NO: 29854
  Description of Artificial Sequence: Synthetic polypeptide
  XENP021563 7G8_H0.71_L0.59_Fab Heavy Chain

SEQ ID NO: 31645 - protein, 121 aa, Artificial Sequence; identical to SEQ ID NO: 18916
  Description of Artificial Sequence: Synthetic polypeptide
  VH of XENP021563

SEQ ID NO: 31646 - protein, 5 aa, Artificial Sequence
  Description of Artificial Sequence: Synthetic peptide
  XENP021563 vhCDR1
DAWMD

SEQ ID NO: 31647 - protein, 19 aa, Artificial Sequence
  Description of Artificial Sequence: Synthetic peptide
  XENP021563 vhCDR2
EIRTKAYNHATYYAESVKG

SEQ ID NO: 31648 - protein, 10 aa, Artificial Sequence
  Description of Artificial Sequence: Synthetic peptide
  XENP021563 vhCDR3
LANWDWYFDV

SEQ ID NO: 31649 - protein, 218 aa, Artificial Sequence; identical to SEQ ID NO: 20280
  Description of Artificial Sequence: Synthetic polypeptide
  XENP021563 7G8_H0.71_L0.59_Fab Light Chain

SEQ ID NO: 31650 - protein, 111 aa, Artificial Sequence; identical to SEQ ID NO: 20281
  Description of Artificial Sequence: Synthetic polypeptide
  VL of XENP021563

SEQ ID NO: 31651 - protein, 15 aa, Artificial Sequence
  Description of Artificial Sequence: Synthetic peptide
  XENP021563 vlCDR1
KASQSVDYDGDSYMN

SEQ ID NO: 31652 - protein, 7 aa, Artificial Sequence
  Description of Artificial Sequence: Synthetic peptide
  XENP021563 vlCDR2
AASELES

SEQ ID NO: 31653 - protein, 9 aa, Artificial Sequence
  Description of Artificial Sequence: Synthetic peptide
  XENP021563 vlCDR3
QQSNEDPFT

SEQ ID NO: 31654 - protein, 226 aa, Artificial Sequence; identical to SEQ ID NO: 28944
  Description of Artificial Sequence: Synthetic polypeptide
  XENP021564 7G8_H3.1_L0_Fab Heavy Chain

SEQ ID NO: 31655 - protein, 121 aa, Artificial Sequence; identical to SEQ ID NO: 28945
  Description of Artificial Sequence: Synthetic polypeptide
  VH of XENP021564

SEQ ID NO: 31656 - protein, 5 aa, Artificial Sequence
  Description of Artificial Sequence: Synthetic peptide
  XENP021564 vhCDR1
DAWMD

SEQ ID NO: 31657 - protein, 19 aa, Artificial Sequence
  Description of Artificial Sequence: Synthetic peptide
  XENP021564 vhCDR2
EIRTKANNHATYYAESVKG

SEQ ID NO: 31658 - protein, 10 aa, Artificial Sequence
  Description of Artificial Sequence: Synthetic peptide
  XENP021564 vhCDR3
LATWDWYFDV

SEQ ID NO: 31659 - protein, 218 aa, Artificial Sequence; identical to SEQ ID NO: 17590
  Description of Artificial Sequence: Synthetic polypeptide
  XENP021564 7G8_H3.1_L0_Fab Light Chain

SEQ ID NO: 31660 - protein, 111 aa, Artificial Sequence; identical to SEQ ID NO: 17591
  Description of Artificial Sequence: Synthetic polypeptide
  VL of XENP021564

SEQ ID NO: 31661 - protein, 15 aa, Artificial Sequence
  Description of Artificial Sequence: Synthetic peptide
  XENP021564 vlCDR1
KASQSVDYDGDSYMN

SEQ ID NO: 31662 - protein, 7 aa, Artificial Sequence
  Description of Artificial Sequence: Synthetic peptide
  XENP021564 vlCDR2
AASNLES

SEQ ID NO: 31663 - protein, 9 aa, Artificial Sequence
  Description of Artificial Sequence: Synthetic peptide
  XENP021564 vlCDR3
QQSNEDPFT

SEQ ID NO: 31664 - protein, 226 aa, Artificial Sequence; identical to SEQ ID NO: 28974
  Description of Artificial Sequence: Synthetic polypeptide
  XENP021565 7G8_H3.4_L0_Fab Heavy Chain

SEQ ID NO: 31665 - protein, 121 aa, Artificial Sequence; identical to SEQ ID NO: 28975
  Description of Artificial Sequence: Synthetic polypeptide
  VH of XENP021565

SEQ ID NO: 31666 - protein, 5 aa, Artificial Sequence
  Description of Artificial Sequence: Synthetic peptide
  XENP021565 vhCDR1
DAWMD

SEQ ID NO: 31667 - protein, 19 aa, Artificial Sequence
  Description of Artificial Sequence: Synthetic peptide
  XENP021565 vhCDR2
EIRTKANNHATYYAESVKG

SEQ ID NO: 31668 - protein, 10 aa, Artificial Sequence
  Description of Artificial Sequence: Synthetic peptide
  XENP021565 vhCDR3
LATWDWYFDV

SEQ ID NO: 31669 - protein, 218 aa, Artificial Sequence; identical to SEQ ID NO: 17590
  Description of Artificial Sequence: Synthetic polypeptide
  XENP021565 7G8_H3.4_L0_Fab Light Chain

SEQ ID NO: 31670 - protein, 111 aa, Artificial Sequence; identical to SEQ ID NO: 17591
  Description of Artificial Sequence: Synthetic polypeptide
  VL of XENP021565

SEQ ID NO: 31671 - protein, 15 aa, Artificial Sequence
  Description of Artificial Sequence: Synthetic peptide
  XENP021565 vlCDR1
KASQSVDYDGDSYMN

SEQ ID NO: 31672 - protein, 7 aa, Artificial Sequence
  Description of Artificial Sequence: Synthetic peptide
  XENP021565 vlCDR2
AASNLES

SEQ ID NO: 31673 - protein, 9 aa, Artificial Sequence
  Description of Artificial Sequence: Synthetic peptide
  XENP021565 vlCDR3
QQSNEDPFT

SEQ ID NO: 31674 - protein, 226 aa, Artificial Sequence; identical to SEQ ID NO: 28944
  Description of Artificial Sequence: Synthetic polypeptide
  XENP021566 7G8_H3.1_L0.11_Fab Heavy Chain

SEQ ID NO: 31675 - protein, 121 aa, Artificial Sequence; identical to SEQ ID NO: 28945
  Description of Artificial Sequence: Synthetic polypeptide
  VH of XENP021566

SEQ ID NO: 31676 - protein, 5 aa, Artificial Sequence
  Description of Artificial Sequence: Synthetic peptide
  XENP021566 vhCDR1
DAWMD

SEQ ID NO: 31677 - protein, 19 aa, Artificial Sequence
  Description of Artificial Sequence: Synthetic peptide
  XENP021566 vhCDR2
EIRTKANNHATYYAESVKG

SEQ ID NO: 31678 - protein, 10 aa, Artificial Sequence
  Description of Artificial Sequence: Synthetic peptide
  XENP021566 vhCDR3
LATWDWYFDV

SEQ ID NO: 31679 - protein, 218 aa, Artificial Sequence; identical to SEQ ID NO: 19800
  Description of Artificial Sequence: Synthetic polypeptide
  XENP021566 7G8_H3.1_L0.11_Fab Light Chain

SEQ ID NO: 31680 - protein, 111 aa, Artificial Sequence; identical to SEQ ID NO: 19801
  Description of Artificial Sequence: Synthetic polypeptide
  VL of XENP021566

SEQ ID NO: 31681 - protein, 15 aa, Artificial Sequence
  Description of Artificial Sequence: Synthetic peptide
  XENP021566 vlCDR1
KASQSVDHDGDSYMN

SEQ ID NO: 31682 - protein, 7 aa, Artificial Sequence
  Description of Artificial Sequence: Synthetic peptide
  XENP021566 vlCDR2
AASNLES

SEQ ID NO: 31683 - protein, 9 aa, Artificial Sequence
  Description of Artificial Sequence: Synthetic peptide
  XENP021566 vlCDR3
QQSNEDPFT

SEQ ID NO: 31684 - protein, 226 aa, Artificial Sequence; identical to SEQ ID NO: 28974
  Description of Artificial Sequence: Synthetic polypeptide
  XENP021567 7G8_H3.4_L0.11_Fab Heavy Chain

SEQ ID NO: 31685 - protein, 121 aa, Artificial Sequence; identical to SEQ ID NO: 28975
  Description of Artificial Sequence: Synthetic polypeptide
  VH of XENP021567

SEQ ID NO: 31686 - protein, 5 aa, Artificial Sequence
  Description of Artificial Sequence: Synthetic peptide
  XENP021567 vhCDR1
DAWMD

SEQ ID NO: 31687 - protein, 19 aa, Artificial Sequence
  Description of Artificial Sequence: Synthetic peptide
  XENP021567 vhCDR2
EIRTKANNHATYYAESVKG

SEQ ID NO: 31688 - protein, 10 aa, Artificial Sequence
  Description of Artificial Sequence: Synthetic peptide
  XENP021567 vhCDR3
LATWDWYFDV

SEQ ID NO: 31689 - protein, 218 aa, Artificial Sequence; identical to SEQ ID NO: 19800
  Description of Artificial Sequence: Synthetic polypeptide
  XENP021567 7G8_H3.4_L0.11_Fab Light Chain

SEQ ID NO: 31690 - protein, 111 aa, Artificial Sequence; identical to SEQ ID NO: 19801
  Description of Artificial Sequence: Synthetic polypeptide
  VL of XENP021567

SEQ ID NO: 31691 - protein, 15 aa, Artificial Sequence
  Description of Artificial Sequence: Synthetic peptide
  XENP021567 vlCDR1
KASQSVDHDGDSYMN

SEQ ID NO: 31692 - protein, 7 aa, Artificial Sequence
  Description of Artificial Sequence: Synthetic peptide
  XENP021567 vlCDR2
AASNLES

SEQ ID NO: 31693 - protein, 9 aa, Artificial Sequence
  Description of Artificial Sequence: Synthetic peptide
  XENP021567 vlCDR3
QQSNEDPFT

SEQ ID NO: 31694 - protein, 226 aa, Artificial Sequence; identical to SEQ ID NO: 30404
  Description of Artificial Sequence: Synthetic polypeptide
  XENP021568 7G8_H0.129_L0.11_Fab Heavy Chain

SEQ ID NO: 31695 - protein, 121 aa, Artificial Sequence; identical to SEQ ID NO: 19496
  Description of Artificial Sequence: Synthetic polypeptide
  VH of XENP021568

SEQ ID NO: 31696 - protein, 5 aa, Artificial Sequence
  Description of Artificial Sequence: Synthetic peptide
  XENP021568 vhCDR1
DAWMD

SEQ ID NO: 31697 - protein, 19 aa, Artificial Sequence
  Description of Artificial Sequence: Synthetic peptide
  XENP021568 vhCDR2
EIRTKANNHATYYAESVKG

SEQ ID NO: 31698 - protein, 10 aa, Artificial Sequence
  Description of Artificial Sequence: Synthetic peptide
  XENP021568 vhCDR3
LATWDWYFDV

SEQ ID NO: 31699 - protein, 218 aa, Artificial Sequence; identical to SEQ ID NO: 19800
  Description of Artificial Sequence: Synthetic polypeptide
  XENP021568 7G8_H0.129_L0.11_Fab Light Chain

SEQ ID NO: 31700 - protein, 111 aa, Artificial Sequence; identical to SEQ ID NO: 19801
  Description of Artificial Sequence: Synthetic polypeptide
  VL of XENP021568

SEQ ID NO: 31701 - protein, 15 aa, Artificial Sequence
  Description of Artificial Sequence: Synthetic peptide
  XENP021568 vlCDR1
KASQSVDHDGDSYMN

SEQ ID NO: 31702 - protein, 7 aa, Artificial Sequence
  Description of Artificial Sequence: Synthetic peptide
  XENP021568 vlCDR2
AASNLES

SEQ ID NO: 31703 - protein, 9 aa, Artificial Sequence
  Description of Artificial Sequence: Synthetic peptide
  XENP021568 vlCDR3
QQSNEDPFT

SEQ ID NO: 31704 - protein, 226 aa, Artificial Sequence; identical to SEQ ID NO: 28944
  Description of Artificial Sequence: Synthetic polypeptide
  XENP021569 7G8_H3.1_L0.34_Fab Heavy Chain

SEQ ID NO: 31705 - protein, 121 aa, Artificial Sequence; identical to SEQ ID NO: 28945
  Description of Artificial Sequence: Synthetic polypeptide
  VH of XENP021569

SEQ ID NO: 31706 - protein, 5 aa, Artificial Sequence
  Description of Artificial Sequence: Synthetic peptide
  XENP021569 vhCDR1
DAWMD

SEQ ID NO: 31707 - protein, 19 aa, Artificial Sequence
  Description of Artificial Sequence: Synthetic peptide
  XENP021569 vhCDR2
EIRTKANNHATYYAESVKG

SEQ ID NO: 31708 - protein, 10 aa, Artificial Sequence
  Description of Artificial Sequence: Synthetic peptide
  XENP021569 vhCDR3
LATWDWYFDV

SEQ ID NO: 31709 - protein, 218 aa, Artificial Sequence; identical to SEQ ID NO: 20030
  Description of Artificial Sequence: Synthetic polypeptide
  XENP021569 7G8_H3.1_L0.34_Fab Light Chain

SEQ ID NO: 31710 - protein, 111 aa, Artificial Sequence; identical to SEQ ID NO: 20031
  Description of Artificial Sequence: Synthetic polypeptide
  VL of XENP021569

SEQ ID NO: 31711 - protein, 15 aa, Artificial Sequence
  Description of Artificial Sequence: Synthetic peptide
  XENP021569 vlCDR1
KASQSVDYDDDSYMN

SEQ ID NO: 31712 - protein, 7 aa, Artificial Sequence
  Description of Artificial Sequence: Synthetic peptide
  XENP021569 vlCDR2
AASNLES

SEQ ID NO: 31713 - protein, 9 aa, Artificial Sequence
  Description of Artificial Sequence: Synthetic peptide
  XENP021569 vlCDR3
QQSNEDPFT

SEQ ID NO: 31714 - protein, 226 aa, Artificial Sequence; identical to SEQ ID NO: 28974
  Description of Artificial Sequence: Synthetic polypeptide
  XENP021570 7G8_H3.4_L0.34_Fab Heavy Chain

SEQ ID NO: 31715 - protein, 121 aa, Artificial Sequence; identical to SEQ ID NO: 28975
  Description of Artificial Sequence: Synthetic polypeptide
  VH of XENP021570

SEQ ID NO: 31716 - protein, 5 aa, Artificial Sequence
  Description of Artificial Sequence: Synthetic peptide
  XENP021570 vhCDR1
DAWMD

SEQ ID NO: 31717 - protein, 19 aa, Artificial Sequence
  Description of Artificial Sequence: Synthetic peptide
  XENP021570 vhCDR2
EIRTKANNHATYYAESVKG

SEQ ID NO: 31718 - protein, 10 aa, Artificial Sequence
  Description of Artificial Sequence: Synthetic peptide
  XENP021570 vhCDR3
LATWDWYFDV

SEQ ID NO: 31719 - protein, 218 aa, Artificial Sequence; identical to SEQ ID NO: 20030
  Description of Artificial Sequence: Synthetic polypeptide
  XENP021570 7G8_H3.4_L0.34_Fab Light Chain

SEQ ID NO: 31720 - protein, 111 aa, Artificial Sequence; identical to SEQ ID NO: 20031
  Description of Artificial Sequence: Synthetic polypeptide
  VL of XENP021570

SEQ ID NO: 31721 - protein, 15 aa, Artificial Sequence
  Description of Artificial Sequence: Synthetic peptide
  XENP021570 vlCDR1
KASQSVDYDDDSYMN

SEQ ID NO: 31722 - protein, 7 aa, Artificial Sequence
  Description of Artificial Sequence: Synthetic peptide
  XENP021570 vlCDR2
AASNLES

SEQ ID NO: 31723 - protein, 9 aa, Artificial Sequence
  Description of Artificial Sequence: Synthetic peptide
  XENP021570 vlCDR3
QQSNEDPFT

SEQ ID NO: 31724 - protein, 226 aa, Artificial Sequence; identical to SEQ ID NO: 30404
  Description of Artificial Sequence: Synthetic polypeptide
  XENP021571 7G8_H0.129_L0.34_Fab Heavy Chain

SEQ ID NO: 31725 - protein, 121 aa, Artificial Sequence; identical to SEQ ID NO: 19496
  Description of Artificial Sequence: Synthetic polypeptide
  VH of XENP021571

SEQ ID NO: 31726 - protein, 5 aa, Artificial Sequence
  Description of Artificial Sequence: Synthetic peptide
  XENP021571 vhCDR1
DAWMD

SEQ ID NO: 31727 - protein, 19 aa, Artificial Sequence
  Description of Artificial Sequence: Synthetic peptide
  XENP021571 vhCDR2
EIRTKANNHATYYAESVKG

SEQ ID NO: 31728 - protein, 10 aa, Artificial Sequence
  Description of Artificial Sequence: Synthetic peptide
  XENP021571 vhCDR3
LATWDWYFDV

SEQ ID NO: 31729 - protein, 218 aa, Artificial Sequence; identical to SEQ ID NO: 20030
  Description of Artificial Sequence: Synthetic polypeptide
  XENP021571 7G8_H0.129_L0.34_Fab Light Chain

SEQ ID NO: 31730 - protein, 111 aa, Artificial Sequence; identical to SEQ ID NO: 20031
  Description of Artificial Sequence: Synthetic polypeptide
  VL of XENP021571

SEQ ID NO: 31731 - protein, 15 aa, Artificial Sequence
  Description of Artificial Sequence: Synthetic peptide
  XENP021571 vlCDR1
KASQSVDYDDDSYMN

SEQ ID NO: 31732 - protein, 7 aa, Artificial Sequence
  Description of Artificial Sequence: Synthetic peptide
  XENP021571 vlCDR2
AASNLES

SEQ ID NO: 31733 - protein, 9 aa, Artificial Sequence
  Description of Artificial Sequence: Synthetic peptide
  XENP021571 vlCDR3
QQSNEDPFT

SEQ ID NO: 31734 - protein, 226 aa, Artificial Sequence
  Description of Artificial Sequence: Synthetic polypeptide
  XENP021662 7G8_H3.18_L1_Fab Heavy Chain
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31735 - protein, 121 aa, Artificial Sequence; identical to SEQ ID NO: 22325
  Description of Artificial Sequence: Synthetic polypeptide
  VH of XENP021662

SEQ ID NO: 31736 - protein, 5 aa, Artificial Sequence
  Description of Artificial Sequence: Synthetic peptide
  XENP021662 vhCDR1
DAWMD

SEQ ID NO: 31737 - protein, 19 aa, Artificial Sequence
  Description of Artificial Sequence: Synthetic peptide
  XENP021662 vhCDR2
EISTKANNHATYYAESVKG

SEQ ID NO: 31738 - protein, 10 aa, Artificial Sequence
  Description of Artificial Sequence: Synthetic peptide
  XENP021662 vhCDR3
LATWDWYFDV

SEQ ID NO: 31739 - protein, 218 aa, Artificial Sequence; identical to SEQ ID NO: 17600
  Description of Artificial Sequence: Synthetic polypeptide
  XENP021662 7G8_H3.18_L1_Fab Light Chain

SEQ ID NO: 31740 - protein, 111 aa, Artificial Sequence; identical to SEQ ID NO: 17601
  Description of Artificial Sequence: Synthetic polypeptide
  VL of XENP021662

SEQ ID NO: 31741 - protein, 15 aa, Artificial Sequence
  Description of Artificial Sequence: Synthetic peptide
  XENP021662 vlCDR1
RASQSVDYDGDSYMN

SEQ ID NO: 31742 - protein, 7 aa, Artificial Sequence
  Description of Artificial Sequence: Synthetic peptide
  XENP021662 vlCDR2
AASNLES

SEQ ID NO: 31743 - protein, 9 aa, Artificial Sequence
  Description of Artificial Sequence: Synthetic peptide
  XENP021662 vlCDR3
QQSNEDPFT

SEQ ID NO: 31744 - protein, 226 aa, Artificial Sequence
  Description of Artificial Sequence: Synthetic polypeptide
  XENP021663 7G8_H3.15_L1_Fab Heavy Chain
EVQLVESGGGLVQPGGSLRLSCAASGDTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31745 - protein, 121 aa, Artificial Sequence; identical to SEQ ID NO: 22365
  Description of Artificial Sequence: Synthetic polypeptide
  VH of XENP021663

SEQ ID NO: 31746 - protein, 5 aa, Artificial Sequence
  Description of Artificial Sequence: Synthetic peptide
  XENP021663 vhCDR1
DAWMD

SEQ ID NO: 31747 - protein, 19 aa, Artificial Sequence
  Description of Artificial Sequence: Synthetic peptide
  XENP021663 vhCDR2
EISTKANNHATYYAESVKG

SEQ ID NO: 31748 - protein, 10 aa, Artificial Sequence
  Description of Artificial Sequence: Synthetic peptide
  XENP021663 vhCDR3
LATWDWYFDV

SEQ ID NO: 31749 - protein, 218 aa, Artificial Sequence; identical to SEQ ID NO: 17600
  Description of Artificial Sequence: Synthetic polypeptide
  XENP021663 7G8_H3.15_L1_Fab Light Chain

SEQ ID NO: 31750 - protein, 111 aa, Artificial Sequence; identical to SEQ ID NO: 17601
  Description of Artificial Sequence: Synthetic polypeptide
  VL of XENP021663

SEQ ID NO: 31751 - protein, 15 aa, Artificial Sequence
  Description of Artificial Sequence: Synthetic peptide
  XENP021663 vlCDR1
RASQSVDYDGDSYMN

SEQ ID NO: 31752 - protein, 7 aa, Artificial Sequence
  Description of Artificial Sequence: Synthetic peptide
  XENP021663 vlCDR2
AASNLES

SEQ ID NO: 31753 - protein, 9 aa, Artificial Sequence
  Description of Artificial Sequence: Synthetic peptide
  XENP021663 vlCDR3
QQSNEDPFT

SEQ ID NO: 31754 - protein, 226 aa, Artificial Sequence
  Description of Artificial Sequence: Synthetic polypeptide
  XENP021664 7G8_H3.19_L1_Fab Heavy Chain
EVQLVESGGGLVQPGGSLRLSCAASGFTFDDAWMDWVRQAPGKGLEWVAEIRTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31755 - protein, 121 aa, Artificial Sequence
  Description of Artificial Sequence: Synthetic polypeptide
  VH of XENP021664
EVQLVESGGGLVQPGGSLRLSCAASGFTFDDAWMDWVRQAPGKGLEWVAEIRTKAYNHATYYAESVKGRFTISRDDSKSSVYLQMNSLRAEDTAVYYCTRLATWDWYFDVWGQGTTVTVSS

SEQ ID NO: 31756 - protein, 5 aa, Artificial Sequence
  Description of Artificial Sequence: Synthetic peptide
  XENP021664 vhCDR1
DAWMD

SEQ ID NO: 31757 - protein, 19 aa, Artificial Sequence
  Description of Artificial Sequence: Synthetic peptide
  XENP021664 vhCDR2
EIRTKAYNHATYYAESVKG

SEQ ID NO: 31758 - protein, 10 aa, Artificial Sequence
  Description of Artificial Sequence: Synthetic peptide
  XENP021664 vhCDR3
LATWDWYFDV

SEQ ID NO: 31759 - protein, 218 aa, Artificial Sequence; identical to SEQ ID NO: 17600
  Description of Artificial Sequence: Synthetic polypeptide
  XENP021664 7G8_H3.19_L1_Fab Light Chain

SEQ ID NO: 31760 - protein, 111 aa, Artificial Sequence; identical to SEQ ID NO: 17601
  Description of Artificial Sequence: Synthetic polypeptide
  VL of XENP021664

SEQ ID NO: 31761 - protein, 15 aa, Artificial Sequence
  Description of Artificial Sequence: Synthetic peptide
  XENP021664 vlCDR1
RASQSVDYDGDSYMN

SEQ ID NO: 31762 - protein, 7 aa, Artificial Sequence
  Description of Artificial Sequence: Synthetic peptide
  XENP021664 vlCDR2
AASNLES

SEQ ID NO: 31763 - protein, 9 aa, Artificial Sequence
  Description of Artificial Sequence: Synthetic peptide
  XENP021664 vlCDR3
QQSNEDPFT

SEQ ID NO: 31764 - protein, 226 aa, Artificial Sequence
  Description of Artificial Sequence: Synthetic polypeptide
  XENP021665 7G8_H3.17_L1_Fab Heavy Chain
EVQLVESGGGLVQPGGSLRLSCAASGDTFDDAWMDWVRQAPGKGLEWVAEIRTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31765 - protein, 121 aa, Artificial Sequence
  Description of Artificial Sequence: Synthetic polypeptide
  VH of XENP021665
EVQLVESGGGLVQPGGSLRLSCAASGDTFDDAWMDWVRQAPGKGLEWVAEIRTKAYNHATYYAESVKGRFTISRDDSKSSVYLQMNSLRAEDTAVYYCTRLATWDWYFDVWGQGTTVTVSS

SEQ ID NO: 31766 - protein, 5 aa, Artificial Sequence
  Description of Artificial Sequence: Synthetic peptide
  XENP021665 vhCDR1
DAWMD

SEQ ID NO: 31767 - protein, 19 aa, Artificial Sequence
  Description of Artificial Sequence: Synthetic peptide
  XENP021665 vhCDR2
EIRTKAYNHATYYAESVKG

SEQ ID NO: 31768 - protein, 10 aa, Artificial Sequence
  Description of Artificial Sequence: Synthetic peptide
  XENP021665 vhCDR3
LATWDWYFDV

SEQ ID NO: 31769 - protein, 218 aa, Artificial Sequence; identical to SEQ ID NO: 17600
  Description of Artificial Sequence: Synthetic polypeptide
  XENP021665 7G8_H3.17_L1_Fab Light Chain

SEQ ID NO: 31770 - protein, 111 aa, Artificial Sequence; identical to SEQ ID NO: 17601
  Description of Artificial Sequence: Synthetic polypeptide
  VL of XENP021665

SEQ ID NO: 31771 - protein, 15 aa, Artificial Sequence
  Description of Artificial Sequence: Synthetic peptide
  XENP021665 vlCDR1
RASQSVDYDGDSYMN

SEQ ID NO: 31772 - protein, 7 aa, Artificial Sequence
  Description of Artificial Sequence: Synthetic peptide
  XENP021665 vlCDR2
AASNLES

SEQ ID NO: 31773 - protein, 9 aa, Artificial Sequence
  Description of Artificial Sequence: Synthetic peptide
  XENP021665 vlCDR3
QQSNEDPFT

SEQ ID NO: 31774 - protein, 226 aa, Artificial Sequence
  Description of Artificial Sequence: Synthetic polypeptide
  XENP021666 7G8_H3.16_L1_Fab Heavy Chain
EVQLVESGGGLVQPGGSLRLSCAASGDTFDDAWMDWVRQAPGKGLEWVAEIRTKANNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31775 - protein, 121 aa, Artificial Sequence
  Description of Artificial Sequence: Synthetic polypeptide
  VH of XENP021666
EVQLVESGGGLVQPGGSLRLSCAASGDTFDDAWMDWVRQAPGKGLEWVAEIRTKANNHATDYAESVKGRFTISRDDSKSSVYLQMNSLRAEDTAVYYCTRLATWDWYFDVWGQGTTVTVSS

SEQ ID NO: 31776 - protein, 5 aa, Artificial Sequence
  Description of Artificial Sequence: Synthetic peptide
  XENP021666 vhCDR1
DAWMD

SEQ ID NO: 31777 - protein, 19 aa, Artificial Sequence
  Description of Artificial Sequence: Synthetic peptide
  XENP021666 vhCDR2
EIRTKANNHATDYAESVKG

SEQ ID NO: 31778 - protein, 10 aa, Artificial Sequence
  Description of Artificial Sequence: Synthetic peptide
  XENP021666 vhCDR3
LATWDWYFDV

SEQ ID NO: 31779 - protein, 218 aa, Artificial Sequence; identical to SEQ ID NO: 17600
  Description of Artificial Sequence: Synthetic polypeptide
  XENP021666 7G8_H3.16_L1_Fab Light Chain

SEQ ID NO: 31780 - protein, 111 aa, Artificial Sequence; identical to SEQ ID NO: 17601
  Description of Artificial Sequence: Synthetic polypeptide
  VL of XENP021666

SEQ ID NO: 31781 - protein, 15 aa, Artificial Sequence
  Description of Artificial Sequence: Synthetic peptide
  XENP021666 vlCDR1
RASQSVDYDGDSYMN

SEQ ID NO: 31782 - protein, 7 aa, Artificial Sequence
  Description of Artificial Sequence: Synthetic peptide
  XENP021666 vlCDR2
AASNLES

SEQ ID NO: 31783 - protein, 9 aa, Artificial Sequence
  Description of Artificial Sequence: Synthetic peptide
  XENP021666 vlCDR3
QQSNEDPFT

SEQ ID NO: 31784 - protein, 226 aa, Artificial Sequence
  Description of Artificial Sequence: Synthetic polypeptide
  XENP021667 7G8_H3.21_L1_Fab Heavy Chain
EVQLVESGGGLVQPGGSLRLSCAASGDTFDDAWMDWVRQAPGKGLEWVAEISTKAYNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31785 - protein, 121 aa, Artificial Sequence
  Description of Artificial Sequence: Synthetic polypeptide
  VH of XENP021667
EVQLVESGGGLVQPGGSLRLSCAASGDTFDDAWMDWVRQAPGKGLEWVAEISTKAYNHATDYAESVKGRFTISRDDSKSSVYLQMNSLRAEDTAVYYCTRLATWDWYFDVWGQGTTVTVSS

SEQ ID NO: 31786 - protein, 5 aa, Artificial Sequence
  Description of Artificial Sequence: Synthetic peptide
  XENP021667 vhCDR1
DAWMD

SEQ ID NO: 31787 - protein, 19 aa, Artificial Sequence
  Description of Artificial Sequence: Synthetic peptide
  XENP021667 vhCDR2
EISTKAYNHATDYAESVKG

SEQ ID NO: 31788 - protein, 10 aa, Artificial Sequence
  Description of Artificial Sequence: Synthetic peptide
  XENP021667 vhCDR3
LATWDWYFDV

SEQ ID NO: 31789 - protein, 218 aa, Artificial Sequence; identical to SEQ ID NO: 17600
  Description of Artificial Sequence: Synthetic polypeptide
  XENP021667 7G8_H3.21_L1_Fab Light Chain

SEQ ID NO: 31790 - protein, 111 aa, Artificial Sequence; identical to SEQ ID NO: 17601
  Description of Artificial Sequence: Synthetic polypeptide
  VL of XENP021667

SEQ ID NO: 31791 - protein, 15 aa, Artificial Sequence
  Description of Artificial Sequence: Synthetic peptide
  XENP021667 vlCDR1
RASQSVDYDGDSYMN

SEQ ID NO: 31792 - protein, 7 aa, Artificial Sequence
  Description of Artificial Sequence: Synthetic peptide
  XENP021667 vlCDR2
AASNLES

SEQ ID NO: 31793 - protein, 9 aa, Artificial Sequence
  Description of Artificial Sequence: Synthetic peptide
  XENP021667 vlCDR3
QQSNEDPFT

SEQ ID NO: 31794 - protein, 226 aa, Artificial Sequence
  Description of Artificial Sequence: Synthetic polypeptide
  XENP021668 7G8_H3.22_L1_Fab Heavy Chain
EVQLVESGGGLVQPGGSLRLSCAASGFTFDDAWMDWVRQAPGKGLEWVAEISTKAYNHATDYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31795 - protein, 121 aa, Artificial Sequence
  Description of Artificial Sequence: Synthetic polypeptide
  VH of XENP021668
EVQLVESGGGLVQPGGSLRLSCAASGFTFDDAWMDWVRQAPGKGLEWVAEISTKAYNHATDYAESVKGRFTISRDDSKSSVYLQMNSLRAEDTAVYYCTRLATWDWYFDVWGQGTTVTVSS

SEQ ID NO: 31796 - protein, 5 aa, Artificial Sequence
  Description of Artificial Sequence: Synthetic peptide
  XENP021668 vhCDR1
DAWMD

SEQ ID NO: 31797 - protein, 19 aa, Artificial Sequence
  Description of Artificial Sequence: Synthetic peptide
  XENP021668 vhCDR2
EISTKAYNHATDYAESVKG

SEQ ID NO: 31798 - protein, 10 aa, Artificial Sequence
  Description of Artificial Sequence: Synthetic peptide
  XENP021668 vhCDR3
LATWDWYFDV

SEQ ID NO: 31799 - protein, 218 aa, Artificial Sequence; identical to SEQ ID NO: 17600
  Description of Artificial Sequence: Synthetic polypeptide
  XENP021668 7G8_H3.22_L1_Fab Light Chain

SEQ ID NO: 31800 - protein, 111 aa, Artificial Sequence; identical to SEQ ID NO: 17601
  Description of Artificial Sequence: Synthetic polypeptide
  VL of XENP021668

SEQ ID NO: 31801 - protein, 15 aa, Artificial Sequence
  Description of Artificial Sequence: Synthetic peptide
  XENP021668 vlCDR1
RASQSVDYDGDSYMN

SEQ ID NO: 31802 - protein, 7 aa, Artificial Sequence
  Description of Artificial Sequence: Synthetic peptide
  XENP021668 vlCDR2
AASNLES

SEQ ID NO: 31803 - protein, 9 aa, Artificial Sequence
  Description of Artificial Sequence: Synthetic peptide
  XENP021668 vlCDR3
QQSNEDPFT

SEQ ID NO: 31804 - protein, 226 aa, Artificial Sequence
  Description of Artificial Sequence: Synthetic polypeptide
  XENP021669 7G8_H3.23_L1_Fab Heavy Chain
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 31805 - protein, 121 aa, Artificial Sequence; identical to SEQ ID NO: 22385
  Description of Artificial Sequence: Synthetic polypeptide
  VH of XENP021669

SEQ ID NO: 31806 - protein, 5 aa, Artificial Sequence
  Description of Artificial Sequence: Synthetic peptide
  XENP021669 vhCDR1
DAWMD

SEQ ID NO: 31807 - protein, 19 aa, Artificial Sequence
  Description of Artificial Sequence: Synthetic peptide
  XENP021669 vhCDR2
EISTKANNHATYYAESVKG

SEQ ID NO: 31808 - protein, 10 aa, Artificial Sequence
  Description of Artificial Sequence: Synthetic peptide
  XENP021669 vhCDR3
LATWDWYFDV

SEQ ID NO: 31809 - protein, 218 aa, Artificial Sequence; identical to SEQ ID NO: 17600
  Description of Artificial Sequence: Synthetic polypeptide
  XENP021669 7G8_H3.23_L1_Fab Light Chain

SEQ ID NO: 31810 - protein, 111 aa, Artificial Sequence; identical to SEQ ID NO: 17601
  Description of Artificial Sequence: Synthetic polypeptide
  VL of XENP021669

SEQ ID NO: 31811 - protein, 15 aa, Artificial Sequence
  Description of Artificial Sequence: Synthetic peptide
  XENP021669 vlCDR1
RASQSVDYDGDSYMN

SEQ ID NO: 31812 - protein, 7 aa, Artificial Sequence
  Description of Artificial Sequence: Synthetic peptide
  XENP021669 vlCDR2
AASNLES

SEQ ID NO: 31813 - protein, 9 aa, Artificial Sequence
  Description of Artificial Sequence: Synthetic peptide
  XENP021669 vlCDR3
QQSNEDPFT

SEQ ID NO: 31814 - protein, 226 aa, Artificial Sequence; identical to SEQ ID NO: 31734
  Description of Artificial Sequence: Synthetic polypeptide
  XENP021670 7G8_H3.18_L1.11_Fab Heavy Chain

SEQ ID NO: 31815 - protein, 121 aa, Artificial Sequence; identical to SEQ ID NO: 22325
  Description of Artificial Sequence: Synthetic polypeptide
  VH of XENP021670

SEQ ID NO: 31816 - protein, 5 aa, Artificial Sequence
  Description of Artificial Sequence: Synthetic peptide
  XENP021670 vhCDR1
DAWMD

SEQ ID NO: 31817 - protein, 19 aa, Artificial Sequence
  Description of Artificial Sequence: Synthetic peptide
  XENP021670 vhCDR2
EISTKANNHATYYAESVKG

SEQ ID NO: 31818 - protein, 10 aa, Artificial Sequence
  Description of Artificial Sequence: Synthetic peptide
  XENP021670 vhCDR3
LATWDWYFDV

SEQ ID NO: 31819 - protein, 218 aa, Artificial Sequence; identical to SEQ ID NO: 22359
  Description of Artificial Sequence: Synthetic polypeptide
  XENP021670 7G8_H3.18_L1.11_Fab Light Chain

SEQ ID NO: 31820 - protein, 111 aa, Artificial Sequence; identical to SEQ ID NO: 22360
  Description of Artificial Sequence: Synthetic polypeptide
  VL of XENP021670

SEQ ID NO: 31821 - protein, 15 aa, Artificial Sequence
  Description of Artificial Sequence: Synthetic peptide
  XENP021670 vlCDR1
RASQSVDYDGDSYMN

SEQ ID NO: 31822 - protein, 7 aa, Artificial Sequence
  Description of Artificial Sequence: Synthetic peptide
  XENP021670 vlCDR2
AASELES

SEQ ID NO: 31823 - protein, 9 aa, Artificial Sequence
  Description of Artificial Sequence: Synthetic peptide
  XENP021670 vlCDR3
QQSNEDPFT

SEQ ID NO: 31824 - protein, 226 aa, Artificial Sequence; identical to SEQ ID NO: 31744
  Description of Artificial Sequence: Synthetic polypeptide
  XENP021671 7G8_H3.15_L1.11_Fab Heavy Chain

SEQ ID NO: 31825 - protein, 121 aa, Artificial Sequence; identical to SEQ ID NO: 22365
  Description of Artificial Sequence: Synthetic polypeptide
  VH of XENP021671

SEQ ID NO: 31826 - protein, 5 aa, Artificial Sequence
  Description of Artificial Sequence: Synthetic peptide
  XENP021671 vhCDR1
DAWMD

SEQ ID NO: 31827 - protein, 19 aa, Artificial Sequence
  Description of Artificial Sequence: Synthetic peptide
  XENP021671 vhCDR2
EISTKANNHATYYAESVKG

SEQ ID NO: 31828 - protein, 10 aa, Artificial Sequence
  Description of Artificial Sequence: Synthetic peptide
  XENP021671 vhCDR3
LATWDWYFDV

SEQ ID NO: 31829 - protein, 218 aa, Artificial Sequence; identical to SEQ ID NO: 22359
  Description of Artificial Sequence: Synthetic polypeptide
  XENP021671 7G8_H3.15_L1.11_Fab Light Chain

SEQ ID NO: 31830 - protein, 111 aa, Artificial Sequence; identical to SEQ ID NO: 22360
  Description of Artificial Sequence: Synthetic polypeptide
  VL of XENP021671

SEQ ID NO: 31831 - protein, 15 aa, Artificial Sequence
  Description of Artificial Sequence: Synthetic peptide
  XENP021671 vlCDR1
RASQSVDYDGDSYMN

SEQ ID NO: 31832 - protein, 7 aa, Artificial Sequence
  Description of Artificial Sequence: Synthetic peptide
  XENP021671 vlCDR2
AASELES

SEQ ID NO: 31833 - protein, 9 aa, Artificial Sequence
  Description of Artificial Sequence: Synthetic peptide
  XENP021671 vlCDR3
QQSNEDPFT

SEQ ID NO: 31834 - protein, 226 aa, Artificial Sequence; identical to SEQ ID NO: 31754
  Description of Artificial Sequence: Synthetic polypeptide
  XENP021672 7G8_H3.19_L1.11_Fab Heavy Chain

SEQ ID NO: 31835 - protein, 121 aa, Artificial Sequence; identical to SEQ ID NO: 31755
  Description of Artificial Sequence: Synthetic polypeptide
  VH of XENP021672

SEQ ID NO: 31836 - protein, 5 aa, Artificial Sequence
  Description of Artificial Sequence: Synthetic peptide
  XENP021672 vhCDR1
DAWMD

SEQ ID NO: 31837 - protein, 19 aa, Artificial Sequence
  Description of Artificial Sequence: Synthetic peptide
  XENP021672 vhCDR2
EIRTKAYNHATYYAESVKG

SEQ ID NO: 31838 - protein, 10 aa, Artificial Sequence
  Description of Artificial Sequence: Synthetic peptide
  XENP021672 vhCDR3
LATWDWYFDV

SEQ ID NO: 31839 - protein, 218 aa, Artificial Sequence; identical to SEQ ID NO: 22359
  Description of Artificial Sequence: Synthetic polypeptide
  XENP021672 7G8_H3.19_L1.11_Fab Light Chain

SEQ ID NO: 31840 - protein, 111 aa, Artificial Sequence; identical to SEQ ID NO: 22360
  Description of Artificial Sequence: Synthetic polypeptide
  VL of XENP021672

SEQ ID NO: 31841 - protein, 15 aa, Artificial Sequence
  Description of Artificial Sequence: Synthetic peptide
  XENP021672 vlCDR1
RASQSVDYDGDSYMN

SEQ ID NO: 31842 - protein, 7 aa, Artificial Sequence
  Description of Artificial Sequence: Synthetic peptide
  XENP021672 vlCDR2
AASELES

SEQ ID NO: 31843 - protein, 9 aa, Artificial Sequence
  Description of Artificial Sequence: Synthetic peptide
  XENP021672 vlCDR3
QQSNEDPFT

SEQ ID NO: 31844 - protein, 226 aa, Artificial Sequence; identical to SEQ ID NO: 31764
  Description of Artificial Sequence: Synthetic polypeptide
  XENP021673 7G8_H3.17_L1.11_Fab Heavy Chain

SEQ ID NO: 31845 - protein, 121 aa, Artificial Sequence; identical to SEQ ID NO: 31765
  Description of Artificial Sequence: Synthetic polypeptide
  VH of XENP021673

SEQ ID NO: 31846 - protein, 5 aa, Artificial Sequence
  Description of Artificial Sequence: Synthetic peptide
  XENP021673 vhCDR1
DAWMD

SEQ ID NO: 31847 - protein, 19 aa, Artificial Sequence
  Description of Artificial Sequence: Synthetic peptide
  XENP021673 vhCDR2
EIRTKAYNHATYYAESVKG

SEQ ID NO: 31848 - protein, 10 aa, Artificial Sequence
  Description of Artificial Sequence: Synthetic peptide
  XENP021673 vhCDR3
LATWDWYFDV

SEQ ID NO: 31849 - protein, 218 aa, Artificial Sequence; identical to SEQ ID NO: 22359
  Description of Artificial Sequence: Synthetic polypeptide
  XENP021673 7G8_H3.17_L1.11_Fab Light Chain

SEQ ID NO: 31850 - protein, 111 aa, Artificial Sequence; identical to SEQ ID NO: 22360
  Description of Artificial Sequence: Synthetic polypeptide
  VL of XENP021673

SEQ ID NO: 31851 - protein, 15 aa, Artificial Sequence
  Description of Artificial Sequence: Synthetic peptide
  XENP021673 vlCDR1
RASQSVDYDGDSYMN

SEQ ID NO: 31852 - protein, 7 aa, Artificial Sequence
  Description of Artificial Sequence: Synthetic peptide
  XENP021673 vlCDR2
AASELES

SEQ ID NO: 31853 - protein, 9 aa, Artificial Sequence
  Description of Artificial Sequence: Synthetic peptide
  XENP021673 vlCDR3
QQSNEDPFT

SEQ ID NO: 31854 - protein, 226 aa, Artificial Sequence; identical to SEQ ID NO: 31774
  Description of Artificial Sequence: Synthetic polypeptide
  XENP021674 7G8_H3.16_L1.11_Fab Heavy Chain

SEQ ID NO: 31855 - protein, 121 aa, Artificial Sequence; identical to SEQ ID NO: 31775
  Description of Artificial Sequence: Synthetic polypeptide
  VH of XENP021674

SEQ ID NO: 31856 - protein, 5 aa, Artificial Sequence
  Description of Artificial Sequence: Synthetic peptide
  XENP021674 vhCDR1
DAWMD

SEQ ID NO: 31857 - protein, 19 aa, Artificial Sequence
  Description of Artificial Sequence: Synthetic peptide
  XENP021674 vhCDR2
EIRTKANNHATDYAESVKG

SEQ ID NO: 31858 - protein, 10 aa, Artificial Sequence
  Description of Artificial Sequence: Synthetic peptide
  XENP021674 vhCDR3
LATWDWYFDV

SEQ ID NO: 31859 - protein, 218 aa, Artificial Sequence; identical to SEQ ID NO: 22359
  Description of Artificial Sequence: Synthetic polypeptide
  XENP021674 7G8_H3.16_L1.11_Fab Light Chain

SEQ ID NO: 31860 - protein, 111 aa, Artificial Sequence; identical to SEQ ID NO: 22360
  Description of Artificial Sequence: Synthetic polypeptide
  VL of XENP021674

SEQ ID NO: 31861 - protein, 15 aa, Artificial Sequence
  Description of Artificial Sequence: Synthetic peptide
  XENP021674 vlCDR1
RASQSVDYDGDSYMN

SEQ ID NO: 31862 - protein, 7 aa, Artificial Sequence
  Description of Artificial Sequence: Synthetic peptide
  XENP021674 vlCDR2
AASELES

SEQ ID NO: 31863 - protein, 9 aa, Artificial Sequence
  Description of Artificial Sequence: Synthetic peptide
  XENP021674 vlCDR3
QQSNEDPFT

SEQ ID NO: 31864 - protein, 226 aa, Artificial Sequence; identical to SEQ ID NO: 31784
  Description of Artificial Sequence: Synthetic polypeptide
  XENP021675 7G8_H3.21_L1.11_Fab Heavy Chain

SEQ ID NO: 31865 - protein, 121 aa, Artificial Sequence; identical to SEQ ID NO: 31785
  Description of Artificial Sequence: Synthetic polypeptide
  VH of XENP021675

SEQ ID NO: 31866 - protein, 5 aa, Artificial Sequence
  Description of Artificial Sequence: Synthetic peptide
  XENP021675 vhCDR1
DAWMD

SEQ ID NO: 31867 - protein, 19 aa, Artificial Sequence
  Description of Artificial Sequence: Synthetic peptide
  XENP021675 vhCDR2
EISTKAYNHATDYAESVKG

SEQ ID NO: 31868 - protein, 10 aa, Artificial Sequence
  Description of Artificial Sequence: Synthetic peptide
  XENP021675 vhCDR3
LATWDWYFDV

SEQ ID NO: 31869 - protein, 218 aa, Artificial Sequence; identical to SEQ ID NO: 22359
  Description of Artificial Sequence: Synthetic polypeptide
  XENP021675 7G8_H3.21_L1.11_Fab Light Chain

SEQ ID NO: 31870 - protein, 111 aa, Artificial Sequence; identical to SEQ ID NO: 22360
  Description of Artificial Sequence: Synthetic polypeptide
  VL of XENP021675

SEQ ID NO: 31871 - protein, 15 aa, Artificial Sequence
  Description of Artificial Sequence: Synthetic peptide
  XENP021675 vlCDR1
RASQSVDYDGDSYMN

SEQ ID NO: 31872 - protein, 7 aa, Artificial Sequence
  Description of Artificial Sequence: Synthetic peptide
  XENP021675 vlCDR2
AASELES

SEQ ID NO: 31873 - protein, 9 aa, Artificial Sequence
  Description of Artificial Sequence: Synthetic peptide
  XENP021675 vlCDR3
QQSNEDPFT

SEQ ID NO: 31874 - protein, 226 aa, Artificial Sequence; identical to SEQ ID NO: 31794
  Description of Artificial Sequence: Synthetic polypeptide
  XENP021676 7G8_H3.22_L1.11_Fab Heavy Chain

SEQ ID NO: 31875 - protein, 121 aa, Artificial Sequence; identical to SEQ ID NO: 31795
  Description of Artificial Sequence: Synthetic polypeptide
  VH of XENP021676

SEQ ID NO: 31876 - protein, 5 aa, Artificial Sequence
  Description of Artificial Sequence: Synthetic peptide
  XENP021676 vhCDR1
DAWMD

SEQ ID NO: 31877 - protein, 19 aa, Artificial Sequence
  Description of Artificial Sequence: Synthetic peptide
  XENP021676 vhCDR2
EISTKAYNHATDYAESVKG

SEQ ID NO: 31878 - protein, 10 aa, Artificial Sequence
  Description of Artificial Sequence: Synthetic peptide
  XENP021676 vhCDR3
LATWDWYFDV

SEQ ID NO: 31879 - protein, 218 aa, Artificial Sequence; identical to SEQ ID NO: 22359
  Description of Artificial Sequence: Synthetic polypeptide
  XENP021676 7G8_H3.22_L1.11_Fab Light Chain

SEQ ID NO: 31880 - protein, 111 aa, Artificial Sequence; identical to SEQ ID NO: 22360
  Description of Artificial Sequence: Synthetic polypeptide
  VL of XENP021676

SEQ ID NO: 31881 - protein, 15 aa, Artificial Sequence
  Description of Artificial Sequence: Synthetic peptide
  XENP021676 vlCDR1
RASQSVDYDGDSYMN

SEQ ID NO: 31882 - protein, 7 aa, Artificial Sequence
  Description of Artificial Sequence: Synthetic peptide
  XENP021676 vlCDR2
AASELES

SEQ ID NO: 31883 - protein, 9 aa, Artificial Sequence
  Description of Artificial Sequence: Synthetic peptide
  XENP021676 vlCDR3
QQSNEDPFT

SEQ ID NO: 31884 - protein, 226 aa, Artificial Sequence; identical to SEQ ID NO: 31804
  Description of Artificial Sequence: Synthetic polypeptide
  XENP021677 7G8_H3.23_L1.11_Fab Heavy Chain

SEQ ID NO: 31885 - protein, 121 aa, Artificial Sequence; identical to SEQ ID NO: 22385
  Description of Artificial Sequence: Synthetic polypeptide
  VH of XENP021677

SEQ ID NO: 31886 - protein, 5 aa, Artificial Sequence
  Description of Artificial Sequence: Synthetic peptide
  XENP021677 vhCDR1
DAWMD

SEQ ID NO: 31887 - protein, 19 aa, Artificial Sequence
  Description of Artificial Sequence: Synthetic peptide
  XENP021677 vhCDR2
EISTKANNHATYYAESVKG

SEQ ID NO: 31888 - protein, 10 aa, Artificial Sequence
  Description of Artificial Sequence: Synthetic peptide
  XENP021677 vhCDR3
LATWDWYFDV

SEQ ID NO: 31889 - protein, 218 aa, Artificial Sequence; identical to SEQ ID NO: 22359
  Description of Artificial Sequence: Synthetic polypeptide
  XENP021677 7G8_H3.23_L1.11_Fab Light Chain

SEQ ID NO: 31890 - protein, 111 aa, Artificial Sequence; identical to SEQ ID NO: 22360
  Description of Artificial Sequence: Synthetic polypeptide
  VL of XENP021677

SEQ ID NO: 31891 - protein, 15 aa, Artificial Sequence
  Description of Artificial Sequence: Synthetic peptide
  XENP021677 vlCDR1
RASQSVDYDGDSYMN

SEQ ID NO: 31892 - protein, 7 aa, Artificial Sequence
  Description of Artificial Sequence: Synthetic peptide
  XENP021677 vlCDR2
AASELES

SEQ ID NO: 31893 - protein, 9 aa, Artificial Sequence
  Description of Artificial Sequence: Synthetic peptide
  XENP021677 vlCDR3
QQSNEDPFT

SEQ ID NO: 31894 - protein, 226 aa, Artificial Sequence; identical to SEQ ID NO: 31734
  Description of Artificial Sequence: Synthetic polypeptide
  XENP021678 7G8_H3.18_L1.13_Fab Heavy Chain

SEQ ID NO: 31895 - protein, 121 aa, Artificial Sequence; identical to SEQ ID NO: 22325
  Description of Artificial Sequence: Synthetic polypeptide
  VH of XENP021678

SEQ ID NO: 31896 - protein, 5 aa, Artificial Sequence
  Description of Artificial Sequence: Synthetic peptide
  XENP021678 vhCDR1
DAWMD

SEQ ID NO: 31897 - protein, 19 aa, Artificial Sequence
  Description of Artificial Sequence: Synthetic peptide
  XENP021678 vhCDR2
EISTKANNHATYYAESVKG

SEQ ID NO: 31898 - protein, 10 aa, Artificial Sequence
  Description of Artificial Sequence: Synthetic peptide
  XENP021678 vhCDR3
LATWDWYFDV

SEQ ID NO: 31899 - protein, 218 aa, Artificial Sequence; identical to SEQ ID NO: 22419
  Description of Artificial Sequence: Synthetic polypeptide
  XENP021678 7G8_H3.18_L1.13_Fab Light Chain

SEQ ID NO: 31900 - protein, 111 aa, Artificial Sequence; identical to SEQ ID NO: 22420
  Description of Artificial Sequence: Synthetic polypeptide
  VL of XENP021678

SEQ ID NO: 31901 - protein, 15 aa, Artificial Sequence
  Description of Artificial Sequence: Synthetic peptide
  XENP021678 vlCDR1
RASQSVDHDGDSYMN

SEQ ID NO: 31902 - protein, 7 aa, Artificial Sequence
  Description of Artificial Sequence: Synthetic peptide
  XENP021678 vlCDR2
AASELES

SEQ ID NO: 31903 - protein, 9 aa, Artificial Sequence
  Description of Artificial Sequence: Synthetic peptide
  XENP021678 vlCDR3
QQSNEDPFT

SEQ ID NO: 31904 - protein, 226 aa, Artificial Sequence; identical to SEQ ID NO: 31744
  Description of Artificial Sequence: Synthetic polypeptide
  XENP021679 7G8_H3.15_L1.13_Fab Heavy Chain

SEQ ID NO: 31905 - protein, 121 aa, Artificial Sequence; identical to SEQ ID NO: 22365
  Description of Artificial Sequence: Synthetic polypeptide
  VH of XENP021679

SEQ ID NO: 31906 - protein, 5 aa, Artificial Sequence
  Description of Artificial Sequence: Synthetic peptide
  XENP021679 vhCDR1
DAWMD

SEQ ID NO: 31907 - protein, 19 aa, Artificial Sequence
  Description of Artificial Sequence: Synthetic peptide
  XENP021679 vhCDR2
EISTKANNHATYYAESVKG

SEQ ID NO: 31908 - protein, 10 aa, Artificial Sequence
  Description of Artificial Sequence: Synthetic peptide
  XENP021679 vhCDR3
LATWDWYFDV

SEQ ID NO: 31909 - protein, 218 aa, Artificial Sequence; identical to SEQ ID NO: 22419
  Description of Artificial Sequence: Synthetic polypeptide
  XENP021679 7G8_H3.15_L1.13_Fab Light Chain

SEQ ID NO: 31910 - protein, 111 aa, Artificial Sequence; identical to SEQ ID NO: 22420
  Description of Artificial Sequence: Synthetic polypeptide
  VL of XENP021679

SEQ ID NO: 31911 - protein, 15 aa, Artificial Sequence
  Description of Artificial Sequence: Synthetic peptide
  XENP021679 vlCDR1
RASQSVDHDGDSYMN

SEQ ID NO: 31912 - protein, 7 aa, Artificial Sequence
  Description of Artificial Sequence: Synthetic peptide
  XENP021679 vlCDR2
AASELES

SEQ ID NO: 31913 - protein, 9 aa, Artificial Sequence
  Description of Artificial Sequence: Synthetic peptide
  XENP021679 vlCDR3
QQSNEDPFT

SEQ ID NO: 31914 - protein, 226 aa, Artificial Sequence; identical to SEQ ID NO: 31754
  Description of Artificial Sequence: Synthetic polypeptide
  XENP021680 7G8_H3.19_L1.13_Fab Heavy Chain

SEQ ID NO: 31915 - protein, 121 aa, Artificial Sequence; identical to SEQ ID NO: 31755
  Description of Artificial Sequence: Synthetic polypeptide
  VH of XENP021680

SEQ ID NO: 31916 - protein, 5 aa, Artificial Sequence
  Description of Artificial Sequence: Synthetic peptide
  XENP021680 vhCDR1
DAWMD

SEQ ID NO: 31917 - protein, 19 aa, Artificial Sequence
  Description of Artificial Sequence: Synthetic peptide
  XENP021680 vhCDR2
EIRTKAYNHATYYAESVKG

SEQ ID NO: 31918 - protein, 10 aa, Artificial Sequence
  Description of Artificial Sequence: Synthetic peptide
  XENP021680 vhCDR3
LATWDWYFDV

SEQ ID NO: 31919 - protein, 218 aa, Artificial Sequence; identical to SEQ ID NO: 22419
  Description of Artificial Sequence: Synthetic polypeptide
  XENP021680 7G8_H3.19_L1.13_Fab Light Chain

SEQ ID NO: 31920 - protein, 111 aa, Artificial Sequence; identical to SEQ ID NO: 22420
  Description of Artificial Sequence: Synthetic polypeptide
  VL of XENP021680

SEQ ID NO: 31921 - protein, 15 aa, Artificial Sequence
  Description of Artificial Sequence: Synthetic peptide
  XENP021680 vlCDR1
RASQSVDHDGDSYMN

SEQ ID NO: 31922 - protein, 7 aa, Artificial Sequence
  Description of Artificial Sequence: Synthetic peptide
  XENP021680 vlCDR2
AASELES

SEQ ID NO: 31923 - protein, 9 aa, Artificial Sequence
  Description of Artificial Sequence: Synthetic peptide
  XENP021680 vlCDR3
QQSNEDPFT

SEQ ID NO: 31924 - protein, 226 aa, Artificial Sequence; identical to SEQ ID NO: 31764
  Description of Artificial Sequence: Synthetic polypeptide
  XENP021681 7G8_H3.17_L1.13_Fab Heavy Chain

SEQ ID NO: 31925 - protein, 121 aa, Artificial Sequence; identical to SEQ ID NO: 31765
  Description of Artificial Sequence: Synthetic polypeptide
  VH of XENP021681

SEQ ID NO: 31926 - protein, 5 aa, Artificial Sequence
  Description of Artificial Sequence: Synthetic peptide
  XENP021681 vhCDR1
DAWMD

SEQ ID NO: 31927 - protein, 19 aa, Artificial Sequence
  Description of Artificial Sequence: Synthetic peptide
  XENP021681 vhCDR2
EIRTKAYNHATYYAESVKG

SEQ ID NO: 31928 - protein, 10 aa, Artificial Sequence
  Description of Artificial Sequence: Synthetic peptide
  XENP021681 vhCDR3
LATWDWYFDV

SEQ ID NO: 31929 - protein, 218 aa, Artificial Sequence; identical to SEQ ID NO: 22419
  Description of Artificial Sequence: Synthetic polypeptide
  XENP021681 7G8_H3.17_L1.13_Fab Light Chain

SEQ ID NO: 31930 - protein, 111 aa, Artificial Sequence; identical to SEQ ID NO: 22420
  Description of Artificial Sequence: Synthetic polypeptide
  VL of XENP021681

SEQ ID NO: 31931 - protein, 15 aa, Artificial Sequence
  Description of Artificial Sequence: Synthetic peptide
  XENP021681 vlCDR1
RASQSVDHDGDSYMN

SEQ ID NO: 31932 - protein, 7 aa, Artificial Sequence
  Description of Artificial Sequence: Synthetic peptide
  XENP021681 vlCDR2
AASELES

SEQ ID NO: 31933 - protein, 9 aa, Artificial Sequence
  Description of Artificial Sequence: Synthetic peptide
  XENP021681 vlCDR3
QQSNEDPFT

SEQ ID NO: 31934 - protein, 226 aa, Artificial Sequence; identical to SEQ ID NO: 31774
  Description of Artificial Sequence: Synthetic polypeptide
  XENP021682 7G8_H3.16_L1.13_Fab Heavy Chain

SEQ ID NO: 31935 - protein, 121 aa, Artificial Sequence; identical to SEQ ID NO: 31775
  Description of Artificial Sequence: Synthetic polypeptide
  VH of XENP021682

SEQ ID NO: 31936 - protein, 5 aa, Artificial Sequence
  Description of Artificial Sequence: Synthetic peptide
  XENP021682 vhCDR1
DAWMD

SEQ ID NO: 31937 - protein, 19 aa, Artificial Sequence
  Description of Artificial Sequence: Synthetic peptide
  XENP021682 vhCDR2
EIRTKANNHATDYAESVKG

SEQ ID NO: 31938 - protein, 10 aa, Artificial Sequence
  Description of Artificial Sequence: Synthetic peptide
  XENP021682 vhCDR3
LATWDWYFDV

SEQ ID NO: 31939 - protein, 218 aa, Artificial Sequence; identical to SEQ ID NO: 22419
  Description of Artificial Sequence: Synthetic polypeptide
  XENP021682 7G8_H3.16_L1.13_Fab Light Chain

SEQ ID NO: 31940 - protein, 111 aa, Artificial Sequence; identical to SEQ ID NO: 22420
  Description of Artificial Sequence: Synthetic polypeptide
  VL of XENP021682

SEQ ID NO: 31941 - protein, 15 aa, Artificial Sequence
  Description of Artificial Sequence: Synthetic peptide
  XENP021682 vlCDR1
RASQSVDHDGDSYMN

SEQ ID NO: 31942 - protein, 7 aa, Artificial Sequence
  Description of Artificial Sequence: Synthetic peptide
  XENP021682 vlCDR2
AASELES

SEQ ID NO: 31943 - protein, 9 aa, Artificial Sequence
  Description of Artificial Sequence: Synthetic peptide
  XENP021682 vlCDR3
QQSNEDPFT

SEQ ID NO: 31944 - protein, 226 aa, Artificial Sequence; identical to SEQ ID NO: 31784
  Description of Artificial Sequence: Synthetic polypeptide
  XENP021683 7G8_H3.21_L1.13_Fab Heavy Chain

SEQ ID NO: 31945 - protein, 121 aa, Artificial Sequence; identical to SEQ ID NO: 31785
  Description of Artificial Sequence: Synthetic polypeptide
  VH of XENP021683

SEQ ID NO: 31946 - protein, 5 aa, Artificial Sequence
  Description of Artificial Sequence: Synthetic peptide
  XENP021683 vhCDR1
DAWMD

SEQ ID NO: 31947 - protein, 19 aa, Artificial Sequence
  Description of Artificial Sequence: Synthetic peptide
  XENP021683 vhCDR2
EISTKAYNHATDYAESVKG

SEQ ID NO: 31948 - protein, 10 aa, Artificial Sequence
  Description of Artificial Sequence: Synthetic peptide
  XENP021683 vhCDR3
LATWDWYFDV

SEQ ID NO: 31949 - protein, 218 aa, Artificial Sequence; identical to SEQ ID NO: 22419
  Description of Artificial Sequence: Synthetic polypeptide
  XENP021683 7G8_H3.21_L1.13_Fab Light Chain

SEQ ID NO: 31950 - protein, 111 aa, Artificial Sequence; identical to SEQ ID NO: 22420
  Description of Artificial Sequence: Synthetic polypeptide
  VL of XENP021683

SEQ ID NO: 31951 - protein, 15 aa, Artificial Sequence
  Description of Artificial Sequence: Synthetic peptide
  XENP021683 vlCDR1
RASQSVDHDGDSYMN

SEQ ID NO: 31952 - protein, 7 aa, Artificial Sequence
  Description of Artificial Sequence: Synthetic peptide
  XENP021683 vlCDR2
AASELES

SEQ ID NO: 31953 - protein, 9 aa, Artificial Sequence
  Description of Artificial Sequence: Synthetic peptide
  XENP021683 vlCDR3
QQSNEDPFT

SEQ ID NO: 31954 - protein, 226 aa, Artificial Sequence; identical to SEQ ID NO: 31794
  Description of Artificial Sequence: Synthetic polypeptide
  XENP021684 7G8_H3.22_L1.13_Fab Heavy Chain

SEQ ID NO: 31955 - protein, 121 aa, Artificial Sequence; identical to SEQ ID NO: 31795
  Description of Artificial Sequence: Synthetic polypeptide
  VH of XENP021684

SEQ ID NO: 31956 - protein, 5 aa, Artificial Sequence
  Description of Artificial Sequence: Synthetic peptide
  XENP021684 vhCDR1
DAWMD

SEQ ID NO: 31957 - protein, 19 aa, Artificial Sequence
  Description of Artificial Sequence: Synthetic peptide
  XENP021684 vhCDR2
EISTKAYNHATDYAESVKG

SEQ ID NO: 31958 - protein, 10 aa, Artificial Sequence
  Description of Artificial Sequence: Synthetic peptide
  XENP021684 vhCDR3
LATWDWYFDV

SEQ ID NO: 31959 - protein, 218 aa, Artificial Sequence; identical to SEQ ID NO: 22419
  Description of Artificial Sequence: Synthetic polypeptide
  XENP021684 7G8_H3.22_L1.13_Fab Light Chain

SEQ ID NO: 31960 - protein, 111 aa, Artificial Sequence; identical to SEQ ID NO: 22420
  Description of Artificial Sequence: Synthetic polypeptide
  VL of XENP021684

SEQ ID NO: 31961 - protein, 15 aa, Artificial Sequence
  Description of Artificial Sequence: Synthetic peptide
  XENP021684 vlCDR1
RASQSVDHDGDSYMN

SEQ ID NO: 31962 - protein, 7 aa, Artificial Sequence
  Description of Artificial Sequence: Synthetic peptide
  XENP021684 vlCDR2
AASELES

SEQ ID NO: 31963 - protein, 9 aa, Artificial Sequence
  Description of Artificial Sequence: Synthetic peptide
  XENP021684 vlCDR3
QQSNEDPFT

SEQ ID NO: 31964 - protein, 226 aa, Artificial Sequence; identical to SEQ ID NO: 31804
  Description of Artificial Sequence: Synthetic polypeptide
  XENP021685 7G8_H3.23_L1.13_Fab Heavy Chain

SEQ ID NO: 31965 - protein, 121 aa, Artificial Sequence; identical to SEQ ID NO: 22385
  Description of Artificial Sequence: Synthetic polypeptide
  VH of XENP021685

SEQ ID NO: 31966 - protein, 5 aa, Artificial Sequence
  Description of Artificial Sequence: Synthetic peptide
  XENP021685 vhCDR1
DAWMD

SEQ ID NO: 31967 - protein, 19 aa, Artificial Sequence
  Description of Artificial Sequence: Synthetic peptide
  XENP021685 vhCDR2
EISTKANNHATYYAESVKG

SEQ ID NO: 31968 - protein, 10 aa, Artificial Sequence
  Description of Artificial Sequence: Synthetic peptide
  XENP021685 vhCDR3
LATWDWYFDV

SEQ ID NO: 31969 - protein, 218 aa, Artificial Sequence; identical to SEQ ID NO: 22419
  Description of Artificial Sequence: Synthetic polypeptide
  XENP021685 7G8_H3.23_L1.13_Fab Light Chain

SEQ ID NO: 31970 - protein, 111 aa, Artificial Sequence; identical to SEQ ID NO: 22420
  Description of Artificial Sequence: Synthetic polypeptide
  VL of XENP021685

SEQ ID NO: 31971 - protein, 15 aa, Artificial Sequence
  Description of Artificial Sequence: Synthetic peptide
  XENP021685 vlCDR1
RASQSVDHDGDSYMN

SEQ ID NO: 31972 - protein, 7 aa, Artificial Sequence
  Description of Artificial Sequence: Synthetic peptide
  XENP021685 vlCDR2
AASELES

SEQ ID NO: 31973 - protein, 9 aa, Artificial Sequence
  Description of Artificial Sequence: Synthetic peptide
  XENP021685 vlCDR3
QQSNEDPFT

SEQ ID NO: 31974 - protein, 226 aa, Artificial Sequence; identical to SEQ ID NO: 31734
  Description of Artificial Sequence: Synthetic polypeptide
  XENP021686 7G8_H3.18_L1.15_Fab Heavy Chain

SEQ ID NO: 31975 - protein, 121 aa, Artificial Sequence; identical to SEQ ID NO: 22325
  Description of Artificial Sequence: Synthetic polypeptide
  VH of XENP021686

SEQ ID NO: 31976 - protein, 5 aa, Artificial Sequence
  Description of Artificial Sequence: Synthetic peptide
  XENP021686 vhCDR1
DAWMD

SEQ ID NO: 31977 - protein, 19 aa, Artificial Sequence
  Description of Artificial Sequence: Synthetic peptide
  XENP021686 vhCDR2
EISTKANNHATYYAESVKG

SEQ ID NO: 31978 - protein, 10 aa, Artificial Sequence
  Description of Artificial Sequence: Synthetic peptide
  XENP021686 vhCDR3
LATWDWYFDV

SEQ ID NO: 31979 - protein, 218 aa, Artificial Sequence
  Description of Artificial Sequence: Synthetic polypeptide
  XENP021686 7G8_H3.18_L1.15_Fab Light Chain
DTVLTQSPSSLSASVGDRVTITCRASQSVDHDDDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31980 - protein, 111 aa, Artificial Sequence
  Description of Artificial Sequence: Synthetic polypeptide
  VL of XENP021686
DTVLTQSPSSLSASVGDRVTITCRASQSVDHDDDSYMNWYQQKPGKPPKLLIYAASELESGIPARLSGSGSGTDFTLTISSLQPEDFATYYCQQSNEDPFTFGSGTKLEIK

SEQ ID NO: 31981 - protein, 15 aa, Artificial Sequence
  Description of Artificial Sequence: Synthetic peptide
  XENP021686 vlCDR1
RASQSVDHDDDSYMN

SEQ ID NO: 31982 - protein, 7 aa, Artificial Sequence
  Description of Artificial Sequence: Synthetic peptide
  XENP021686 vlCDR2
AASELES

SEQ ID NO: 31983 - protein, 9 aa, Artificial Sequence
  Description of Artificial Sequence: Synthetic peptide
  XENP021686 vlCDR3
QQSNEDPFT

SEQ ID NO: 31984 - protein, 226 aa, Artificial Sequence; identical to SEQ ID NO: 31744
  Description of Artificial Sequence: Synthetic polypeptide
  XENP021687 7G8_H3.15_L1.15_Fab Heavy Chain

SEQ ID NO: 31985 - protein, 121 aa, Artificial Sequence; identical to SEQ ID NO: 22365
  Description of Artificial Sequence: Synthetic polypeptide
  VH of XENP021687

SEQ ID NO: 31986 - protein, 5 aa, Artificial Sequence
  Description of Artificial Sequence: Synthetic peptide
  XENP021687 vhCDR1
DAWMD

SEQ ID NO: 31987 - protein, 19 aa, Artificial Sequence
  Description of Artificial Sequence: Synthetic peptide
  XENP021687 vhCDR2
EISTKANNHATYYAESVKG

SEQ ID NO: 31988 - protein, 10 aa, Artificial Sequence
  Description of Artificial Sequence: Synthetic peptide
  XENP021687 vhCDR3
LATWDWYFDV

SEQ ID NO: 31989 - protein, 218 aa, Artificial Sequence; identical to SEQ ID NO: 31979
  Description of Artificial Sequence: Synthetic polypeptide
  XENP021687 7G8_H3.15_L1.15_Fab Light Chain

SEQ ID NO: 31990 - protein, 111 aa, Artificial Sequence; identical to SEQ ID NO: 31980
  Description of Artificial Sequence: Synthetic polypeptide
  VL of XENP021687

SEQ ID NO: 31991 - protein, 15 aa, Artificial Sequence
  Description of Artificial Sequence: Synthetic peptide
  XENP021687 vlCDR1
RASQSVDHDDDSYMN

SEQ ID NO: 31992 - protein, 7 aa, Artificial Sequence
  Description of Artificial Sequence: Synthetic peptide
  XENP021687 vlCDR2
AASELES

SEQ ID NO: 31993 - protein, 9 aa, Artificial Sequence
  Description of Artificial Sequence: Synthetic peptide
  XENP021687 vlCDR3
QQSNEDPFT

SEQ ID NO: 31994 - protein, 226 aa, Artificial Sequence; identical to SEQ ID NO: 31754
  Description of Artificial Sequence: Synthetic polypeptide
  XENP021688 7G8_H3.19_L1.15_Fab Heavy Chain

SEQ ID NO: 31995 - protein, 121 aa, Artificial Sequence; identical to SEQ ID NO: 31755
  Description of Artificial Sequence: Synthetic polypeptide
  VH of XENP021688

SEQ ID NO: 31996 - protein, 5 aa, Artificial Sequence
  Description of Artificial Sequence: Synthetic peptide
  XENP021688 vhCDR1
DAWMD

SEQ ID NO: 31997 - protein, 19 aa, Artificial Sequence
  Description of Artificial Sequence: Synthetic peptide
  XENP021688 vhCDR2
EIRTKAYNHATYYAESVKG

SEQ ID NO: 31998 - protein, 10 aa, Artificial Sequence
  Description of Artificial Sequence: Synthetic peptide
  XENP021688 vhCDR3
LATWDWYFDV

SEQ ID NO: 31999 - protein, 218 aa, Artificial Sequence; identical to SEQ ID NO: 31979
  Description of Artificial Sequence: Synthetic polypeptide
  XENP021688 7G8_H3.19_L1.15_Fab Light Chain

SEQ ID NO: 32000 - protein, 111 aa, Artificial Sequence; identical to SEQ ID NO: 31980
  Description of Artificial Sequence: Synthetic polypeptide
  VL of XENP021688

SEQ ID NO: 32001 - protein, 15 aa, Artificial Sequence
  Description of Artificial Sequence: Synthetic peptide
  XENP021688 vlCDR1
RASQSVDHDDDSYMN

SEQ ID NO: 32002 - protein, 7 aa, Artificial Sequence
  Description of Artificial Sequence: Synthetic peptide
  XENP021688 vlCDR2
AASELES

SEQ ID NO: 32003 - protein, 9 aa, Artificial Sequence
  Description of Artificial Sequence: Synthetic peptide
  XENP021688 vlCDR3
QQSNEDPFT

SEQ ID NO: 32004 - protein, 226 aa, Artificial Sequence; identical to SEQ ID NO: 31764
  Description of Artificial Sequence: Synthetic polypeptide
  XENP021689 7G8_H3.17_L1.15_Fab Heavy Chain

SEQ ID NO: 32005 - protein, 121 aa, Artificial Sequence; identical to SEQ ID NO: 31765
  Description of Artificial Sequence: Synthetic polypeptide
  VH of XENP021689

SEQ ID NO: 32006 - protein, 5 aa, Artificial Sequence
  Description of Artificial Sequence: Synthetic peptide
  XENP021689 vhCDR1
DAWMD

SEQ ID NO: 32007 - protein, 19 aa, Artificial Sequence
  Description of Artificial Sequence: Synthetic peptide
  XENP021689 vhCDR2
EIRTKAYNHATYYAESVKG

SEQ ID NO: 32008 - protein, 10 aa, Artificial Sequence
  Description of Artificial Sequence: Synthetic peptide
  XENP021689 vhCDR3
LATWDWYFDV

SEQ ID NO: 32009 - protein, 218 aa, Artificial Sequence; identical to SEQ ID NO: 31979
  Description of Artificial Sequence: Synthetic polypeptide
  XENP021689 7G8_H3.17_L1.15_Fab Light Chain

SEQ ID NO: 32010 - protein, 111 aa, Artificial Sequence; identical to SEQ ID NO: 31980
  Description of Artificial Sequence: Synthetic polypeptide
  VL of XENP021689

SEQ ID NO: 32011 - protein, 15 aa, Artificial Sequence
  Description of Artificial Sequence: Synthetic peptide
  XENP021689 vlCDR1
RASQSVDHDDDSYMN

SEQ ID NO: 32012 - protein, 7 aa, Artificial Sequence
  Description of Artificial Sequence: Synthetic peptide
  XENP021689 vlCDR2
AASELES

SEQ ID NO: 32013 - protein, 9 aa, Artificial Sequence
  Description of Artificial Sequence: Synthetic peptide
  XENP021689 vlCDR3
QQSNEDPFT

SEQ ID NO: 32014 - protein, 226 aa, Artificial Sequence; identical to SEQ ID NO: 31774
  Description of Artificial Sequence: Synthetic polypeptide
  XENP021690 7G8_H3.16_L1.15_Fab Heavy Chain

SEQ ID NO: 32015 - protein, 121 aa, Artificial Sequence; identical to SEQ ID NO: 31775
  Description of Artificial Sequence: Synthetic polypeptide
  VH of XENP021690

SEQ ID NO: 32016 - protein, 5 aa, Artificial Sequence
  Description of Artificial Sequence: Synthetic peptide
  XENP021690 vhCDR1
DAWMD

SEQ ID NO: 32017 - protein, 19 aa, Artificial Sequence
  Description of Artificial Sequence: Synthetic peptide
  XENP021690 vhCDR2
EIRTKANNHATDYAESVKG

SEQ ID NO: 32018 - protein, 10 aa, Artificial Sequence
  Description of Artificial Sequence: Synthetic peptide
  XENP021690 vhCDR3
LATWDWYFDV

SEQ ID NO: 32019 - protein, 218 aa, Artificial Sequence; identical to SEQ ID NO: 31979
  Description of Artificial Sequence: Synthetic polypeptide
  XENP021690 7G8_H3.16_L1.15_Fab Light Chain

SEQ ID NO: 32020 - protein, 111 aa, Artificial Sequence; identical to SEQ ID NO: 31980
  Description of Artificial Sequence: Synthetic polypeptide
  VL of XENP021690

SEQ ID NO: 32021 - protein, 15 aa, Artificial Sequence
  Description of Artificial Sequence: Synthetic peptide
  XENP021690 vlCDR1
RASQSVDHDDDSYMN

SEQ ID NO: 32022 - protein, 7 aa, Artificial Sequence
  Description of Artificial Sequence: Synthetic peptide
  XENP021690 vlCDR2
AASELES

SEQ ID NO: 32023 - protein, 9 aa, Artificial Sequence
  Description of Artificial Sequence: Synthetic peptide
  XENP021690 vlCDR3
QQSNEDPFT

SEQ ID NO: 32024 - protein, 226 aa, Artificial Sequence; identical to SEQ ID NO: 31784
  Description of Artificial Sequence: Synthetic polypeptide
  XENP021691 7G8_H3.21_L1.15_Fab Heavy Chain

SEQ ID NO: 32025 - protein, 121 aa, Artificial Sequence; identical to SEQ ID NO: 31785
  Description of Artificial Sequence: Synthetic polypeptide
  VH of XENP021691

SEQ ID NO: 32026 - protein, 5 aa, Artificial Sequence
  Description of Artificial Sequence: Synthetic peptide
  XENP021691 vhCDR1
DAWMD

SEQ ID NO: 32027 - protein, 19 aa, Artificial Sequence
  Description of Artificial Sequence: Synthetic peptide
  XENP021691 vhCDR2
EISTKAYNHATDYAESVKG

SEQ ID NO: 32028 - protein, 10 aa, Artificial Sequence
  Description of Artificial Sequence: Synthetic peptide
  XENP021691 vhCDR3
LATWDWYFDV

SEQ ID NO: 32029 - protein, 218 aa, Artificial Sequence; identical to SEQ ID NO: 31979
  Description of Artificial Sequence: Synthetic polypeptide
  XENP021691 7G8_H3.21_L1.15_Fab Light Chain

SEQ ID NO: 32030 - protein, 111 aa, Artificial Sequence; identical to SEQ ID NO: 31980
  Description of Artificial Sequence: Synthetic polypeptide
  VL of XENP021691

SEQ ID NO: 32031 - protein, 15 aa, Artificial Sequence
  Description of Artificial Sequence: Synthetic peptide
  XENP021691 vlCDR1
RASQSVDHDDDSYMN

SEQ ID NO: 32032 - protein, 7 aa, Artificial Sequence
  Description of Artificial Sequence: Synthetic peptide
  XENP021691 vlCDR2
AASELES

SEQ ID NO: 32033 - protein, 9 aa, Artificial Sequence
  Description of Artificial Sequence: Synthetic peptide
  XENP021691 vlCDR3
QQSNEDPFT

SEQ ID NO: 32034 - protein, 226 aa, Artificial Sequence; identical to SEQ ID NO: 31794
  Description of Artificial Sequence: Synthetic polypeptide
  XENP021692 7G8_H3.22_L1.15_Fab Heavy Chain

SEQ ID NO: 32035 - protein, 121 aa, Artificial Sequence; identical to SEQ ID NO: 31795
  Description of Artificial Sequence: Synthetic polypeptide
  VH of XENP021692

SEQ ID NO: 32036 - protein, 5 aa, Artificial Sequence
  Description of Artificial Sequence: Synthetic peptide
  XENP021692 vhCDR1
DAWMD

SEQ ID NO: 32037 - protein, 19 aa, Artificial Sequence
  Description of Artificial Sequence: Synthetic peptide
  XENP021692 vhCDR2
EISTKAYNHATDYAESVKG

SEQ ID NO: 32038 - protein, 10 aa, Artificial Sequence
  Description of Artificial Sequence: Synthetic peptide
  XENP021692 vhCDR3
LATWDWYFDV

SEQ ID NO: 32039 - protein, 218 aa, Artificial Sequence; identical to SEQ ID NO: 31979
  Description of Artificial Sequence: Synthetic polypeptide
  XENP021692 7G8_H3.22_L1.15_Fab Light Chain

SEQ ID NO: 32040 - protein, 111 aa, Artificial Sequence; identical to SEQ ID NO: 31980
  Description of Artificial Sequence: Synthetic polypeptide
  VL of XENP021692

SEQ ID NO: 32041 - protein, 15 aa, Artificial Sequence
  Description of Artificial Sequence: Synthetic peptide
  XENP021692 vlCDR1
RASQSVDHDDDSYMN

SEQ ID NO: 32042 - protein, 7 aa, Artificial Sequence
  Description of Artificial Sequence: Synthetic peptide
  XENP021692 vlCDR2
AASELES

SEQ ID NO: 32043 - protein, 9 aa, Artificial Sequence
  Description of Artificial Sequence: Synthetic peptide
  XENP021692 vlCDR3
QQSNEDPFT

SEQ ID NO: 32044 - protein, 226 aa, Artificial Sequence; identical to SEQ ID NO: 31804
  Description of Artificial Sequence: Synthetic polypeptide
  XENP021693 7G8_H3.23_L1.15_Fab Heavy Chain

SEQ ID NO: 32045 - protein, 121 aa, Artificial Sequence; identical to SEQ ID NO: 22385
  Description of Artificial Sequence: Synthetic polypeptide
  VH of XENP021693

SEQ ID NO: 32046 - protein, 5 aa, Artificial Sequence
  Description of Artificial Sequence: Synthetic peptide
  XENP021693 vhCDR1
DAWMD

SEQ ID NO: 32047 - protein, 19 aa, Artificial Sequence
  Description of Artificial Sequence: Synthetic peptide
  XENP021693 vhCDR2
EISTKANNHATYYAESVKG

SEQ ID NO: 32048 - protein, 10 aa, Artificial Sequence
  Description of Artificial Sequence: Synthetic peptide
  XENP021693 vhCDR3
LATWDWYFDV

SEQ ID NO: 32049 - protein, 218 aa, Artificial Sequence; identical to SEQ ID NO: 31979
  Description of Artificial Sequence: Synthetic polypeptide
  XENP021693 7G8_H3.23_L1.15_Fab Light Chain

SEQ ID NO: 32050 - protein, 111 aa, Artificial Sequence; identical to SEQ ID NO: 31980
  Description of Artificial Sequence: Synthetic polypeptide
  VL of XENP021693

SEQ ID NO: 32051 - protein, 15 aa, Artificial Sequence
  Description of Artificial Sequence: Synthetic peptide
  XENP021693 vlCDR1
RASQSVDHDDDSYMN

SEQ ID NO: 32052 - protein, 7 aa, Artificial Sequence
  Description of Artificial Sequence: Synthetic peptide
  XENP021693 vlCDR2
AASELES

SEQ ID NO: 32053 - protein, 9 aa, Artificial Sequence
  Description of Artificial Sequence: Synthetic peptide
  XENP021693 vlCDR3
QQSNEDPFT

SEQ ID NO: 32054 - protein, 226 aa, Artificial Sequence; identical to SEQ ID NO: 28934
  Description of Artificial Sequence: Synthetic polypeptide
  XENP021694 7G8_H3_L1.9_Fab Heavy Chain

SEQ ID NO: 32055 - protein, 121 aa, Artificial Sequence; identical to SEQ ID NO: 17806
  Description of Artificial Sequence: Synthetic polypeptide
  VH of XENP021694

SEQ ID NO: 32056 - protein, 5 aa, Artificial Sequence
  Description of Artificial Sequence: Synthetic peptide
  XENP021694 vhCDR1
DAWMD

SEQ ID NO: 32057 - protein, 19 aa, Artificial Sequence
  Description of Artificial Sequence: Synthetic peptide
  XENP021694 vhCDR2
EIRTKANNHATYYAESVKG

SEQ ID NO: 32058 - protein, 10 aa, Artificial Sequence
  Description of Artificial Sequence: Synthetic peptide
  XENP021694 vhCDR3
LANWDWYFDV

SEQ ID NO: 32059 - protein, 218 aa, Artificial Sequence
  Description of Artificial Sequence: Synthetic polypeptide
  XENP021694 7G8_H3_L1.9_Fab Light Chain
DTVLTQSPSSLSASVGDRVTITCRASQSVDHDGDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32060 - protein, 111 aa, Artificial Sequence
  Description of Artificial Sequence: Synthetic polypeptide
  VL of XENP021694
DTVLTQSPSSLSASVGDRVTITCRASQSVDHDGDSYMNWYQQKPGKPPKLLIYAASNLESGIPARLSGSGSGTDFTLTISSLQPEDFATYYCQQSNEDPFTFGSGTKLEIK

SEQ ID NO: 32061 - protein, 15 aa, Artificial Sequence
  Description of Artificial Sequence: Synthetic peptide
  XENP021694 vlCDR1
RASQSVDHDGDSYMN

SEQ ID NO: 32062 - protein, 7 aa, Artificial Sequence
  Description of Artificial Sequence: Synthetic peptide
  XENP021694 vlCDR2
AASNLES

SEQ ID NO: 32063 - protein, 9 aa, Artificial Sequence
  Description of Artificial Sequence: Synthetic peptide
  XENP021694 vlCDR3
QQSNEDPFT

SEQ ID NO: 32064 - protein, 226 aa, Artificial Sequence; identical to SEQ ID NO: 28934
  Description of Artificial Sequence: Synthetic polypeptide
  XENP021695 7G8_H3_L1.10_Fab Heavy Chain

SEQ ID NO: 32065 - protein, 121 aa, Artificial Sequence; identical to SEQ ID NO: 17806
  Description of Artificial Sequence: Synthetic polypeptide
  VH of XENP021695

SEQ ID NO: 32066 - protein, 5 aa, Artificial Sequence
  Description of Artificial Sequence: Synthetic peptide
  XENP021695 vhCDR1
DAWMD

SEQ ID NO: 32067 - protein, 19 aa, Artificial Sequence
  Description of Artificial Sequence: Synthetic peptide
  XENP021695 vhCDR2
EIRTKANNHATYYAESVKG

SEQ ID NO: 32068 - protein, 10 aa, Artificial Sequence
  Description of Artificial Sequence: Synthetic peptide
  XENP021695 vhCDR3
LANWDWYFDV

SEQ ID NO: 32069 - protein, 218 aa, Artificial Sequence
  Description of Artificial Sequence: Synthetic polypeptide
  XENP021695 7G8_H3_L1.10_Fab Light Chain
DTVLTQSPSSLSASVGDRVTITCRASQSVDYDDDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32070 - protein, 111 aa, Artificial Sequence
  Description of Artificial Sequence: Synthetic polypeptide
  VL of XENP021695
DTVLTQSPSSLSASVGDRVTITCRASQSVDYDDDSYMNWYQQKPGKPPKLLIYAASNLESGIPARLSGSGSGTDFTLTISSLQPEDFATYYCQQSNEDPFTFGSGTKLEIK

SEQ ID NO: 32071 - protein, 15 aa, Artificial Sequence
  Description of Artificial Sequence: Synthetic peptide
  XENP021695 vlCDR1
RASQSVDYDDDSYMN

SEQ ID NO: 32072 - protein, 7 aa, Artificial Sequence
  Description of Artificial Sequence: Synthetic peptide
  XENP021695 vlCDR2
AASNLES

SEQ ID NO: 32073 - protein, 9 aa, Artificial Sequence
  Description of Artificial Sequence: Synthetic peptide
  XENP021695 vlCDR3
QQSNEDPFT

SEQ ID NO: 32074 - protein, 226 aa, Artificial Sequence; identical to SEQ ID NO: 28934
  Description of Artificial Sequence: Synthetic polypeptide
  XENP021696 7G8_H3_L1.11_Fab Heavy Chain

SEQ ID NO: 32075 - protein, 121 aa, Artificial Sequence; identical to SEQ ID NO: 17806
  Description of Artificial Sequence: Synthetic polypeptide
  VH of XENP021696

SEQ ID NO: 32076 - protein, 5 aa, Artificial Sequence
  Description of Artificial Sequence: Synthetic peptide
  XENP021696 vhCDR1
DAWMD

SEQ ID NO: 32077 - protein, 19 aa, Artificial Sequence
  Description of Artificial Sequence: Synthetic peptide
  XENP021696 vhCDR2
EIRTKANNHATYYAESVKG

SEQ ID NO: 32078 - protein, 10 aa, Artificial Sequence
  Description of Artificial Sequence: Synthetic peptide
  XENP021696 vhCDR3
LANWDWYFDV

SEQ ID NO: 32079 - protein, 218 aa, Artificial Sequence; identical to SEQ ID NO: 22359
  Description of Artificial Sequence: Synthetic polypeptide
  XENP021696 7G8_H3_L1.11_Fab Light Chain

SEQ ID NO: 32080 - protein, 111 aa, Artificial Sequence; identical to SEQ ID NO: 22360
  Description of Artificial Sequence: Synthetic polypeptide
  VL of XENP021696

SEQ ID NO: 32081 - protein, 15 aa, Artificial Sequence
  Description of Artificial Sequence: Synthetic peptide
  XENP021696 vlCDR1
RASQSVDYDGDSYMN

SEQ ID NO: 32082 - protein, 7 aa, Artificial Sequence
  Description of Artificial Sequence: Synthetic peptide
  XENP021696 vlCDR2
AASELES

SEQ ID NO: 32083 - protein, 9 aa, Artificial Sequence
  Description of Artificial Sequence: Synthetic peptide
  XENP021696 vlCDR3
QQSNEDPFT

SEQ ID NO: 32084 - protein, 226 aa, Artificial Sequence; identical to SEQ ID NO: 28934
  Description of Artificial Sequence: Synthetic polypeptide
  XENP021701 7G8_H3_L1.12_Fab Heavy Chain

SEQ ID NO: 32085 - protein, 121 aa, Artificial Sequence; identical to SEQ ID NO: 17806
  Description of Artificial Sequence: Synthetic polypeptide
  VH of XENP021701

SEQ ID NO: 32086 - protein, 5 aa, Artificial Sequence
  Description of Artificial Sequence: Synthetic peptide
  XENP021701 vhCDR1
DAWMD

SEQ ID NO: 32087 - protein, 19 aa, Artificial Sequence
  Description of Artificial Sequence: Synthetic peptide
  XENP021701 vhCDR2
EIRTKANNHATYYAESVKG

SEQ ID NO: 32088 - protein, 10 aa, Artificial Sequence
  Description of Artificial Sequence: Synthetic peptide
  XENP021701 vhCDR3
LANWDWYFDV

SEQ ID NO: 32089 - protein, 218 aa, Artificial Sequence
  Description of Artificial Sequence: Synthetic polypeptide
  XENP021701 7G8_H3_L1.12_Fab Light Chain
DTVLTQSPSSLSASVGDRVTITCRASQSVDHDDDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32090 - protein, 111 aa, Artificial Sequence
  Description of Artificial Sequence: Synthetic polypeptide
  VL of XENP021701
DTVLTQSPSSLSASVGDRVTITCRASQSVDHDDDSYMNWYQQKPGKPPKLLIYAASNLESGIPARLSGSGSGTDFTLTISSLQPEDFATYYCQQSNEDPFTFGSGTKLEIK

SEQ ID NO: 32091 - protein, 15 aa, Artificial Sequence
  Description of Artificial Sequence: Synthetic peptide
  XENP021701 vlCDR1
RASQSVDHDDDSYMN

SEQ ID NO: 32092 - protein, 7 aa, Artificial Sequence
  Description of Artificial Sequence: Synthetic peptide
  XENP021701 vlCDR2
AASNLES

SEQ ID NO: 32093 - protein, 9 aa, Artificial Sequence
  Description of Artificial Sequence: Synthetic peptide
  XENP021701 vlCDR3
QQSNEDPFT

SEQ ID NO: 32094 - protein, 226 aa, Artificial Sequence; identical to SEQ ID NO: 28934
  Description of Artificial Sequence: Synthetic polypeptide
  XENP021702 7G8_H3_L1.13_Fab Heavy Chain

SEQ ID NO: 32095 - protein, 121 aa, Artificial Sequence; identical to SEQ ID NO: 17806
  Description of Artificial Sequence: Synthetic polypeptide
  VH of XENP021702

SEQ ID NO: 32096 - protein, 5 aa, Artificial Sequence
  Description of Artificial Sequence: Synthetic peptide
  XENP021702 vhCDR1
DAWMD

SEQ ID NO: 32097 - protein, 19 aa, Artificial Sequence
  Description of Artificial Sequence: Synthetic peptide
  XENP021702 vhCDR2
EIRTKANNHATYYAESVKG

SEQ ID NO: 32098 - protein, 10 aa, Artificial Sequence
  Description of Artificial Sequence: Synthetic peptide
  XENP021702 vhCDR3
LANWDWYFDV

SEQ ID NO: 32099 - protein, 218 aa, Artificial Sequence; identical to SEQ ID NO: 22419
  Description of Artificial Sequence: Synthetic polypeptide
  XENP021702 7G8_H3_L1.13_Fab Light Chain

SEQ ID NO: 32100 - protein, 111 aa, Artificial Sequence; identical to SEQ ID NO: 22420
  Description of Artificial Sequence: Synthetic polypeptide
  VL of XENP021702

SEQ ID NO: 32101 - protein, 15 aa, Artificial Sequence
  Description of Artificial Sequence: Synthetic peptide
  XENP021702 vlCDR1
RASQSVDHDGDSYMN

SEQ ID NO: 32102 - protein, 7 aa, Artificial Sequence
  Description of Artificial Sequence: Synthetic peptide
  XENP021702 vlCDR2
AASELES

SEQ ID NO: 32103 - protein, 9 aa, Artificial Sequence
  Description of Artificial Sequence: Synthetic peptide
  XENP021702 vlCDR3
QQSNEDPFT

SEQ ID NO: 32104 - protein, 226 aa, Artificial Sequence; identical to SEQ ID NO: 28934
  Description of Artificial Sequence: Synthetic polypeptide
  XENP021703 7G8_H3_L1.14_Fab Heavy Chain

SEQ ID NO: 32105 - protein, 121 aa, Artificial Sequence; identical to SEQ ID NO: 17806
  Description of Artificial Sequence: Synthetic polypeptide
  VH of XENP021703

SEQ ID NO: 32106 - protein, 5 aa, Artificial Sequence
  Description of Artificial Sequence: Synthetic peptide
  XENP021703 vhCDR1
DAWMD

SEQ ID NO: 32107 - protein, 19 aa, Artificial Sequence
  Description of Artificial Sequence: Synthetic peptide
  XENP021703 vhCDR2
EIRTKANNHATYYAESVKG

SEQ ID NO: 32108 - protein, 10 aa, Artificial Sequence
  Description of Artificial Sequence: Synthetic peptide
  XENP021703 vhCDR3
LANWDWYFDV

SEQ ID NO: 32109 - protein, 218 aa, Artificial Sequence; identical to SEQ ID NO: 29039
  Description of Artificial Sequence: Synthetic polypeptide
  XENP021703 7G8_H3_L1.14_Fab Light Chain

SEQ ID NO: 32110 - protein, 111 aa, Artificial Sequence; identical to SEQ ID NO: 29040
  Description of Artificial Sequence: Synthetic polypeptide
  VL of XENP021703

SEQ ID NO: 32111 - protein, 15 aa, Artificial Sequence
  Description of Artificial Sequence: Synthetic peptide
  XENP021703 vlCDR1
RASQSVDYDDDSYMN

SEQ ID NO: 32112 - protein, 7 aa, Artificial Sequence
  Description of Artificial Sequence: Synthetic peptide
  XENP021703 vlCDR2
AASELES

SEQ ID NO: 32113 - protein, 9 aa, Artificial Sequence
  Description of Artificial Sequence: Synthetic peptide
  XENP021703 vlCDR3
QQSNEDPFT

SEQ ID NO: 32114 - protein, 226 aa, Artificial Sequence; identical to SEQ ID NO: 28934
  Description of Artificial Sequence: Synthetic polypeptide
  XENP021704 7G8_H3_L1.15_Fab Heavy Chain

SEQ ID NO: 32115 - protein, 121 aa, Artificial Sequence; identical to SEQ ID NO: 17806
  Description of Artificial Sequence: Synthetic polypeptide
  VH of XENP021704

SEQ ID NO: 32116 - protein, 5 aa, Artificial Sequence
  Description of Artificial Sequence: Synthetic peptide
  XENP021704 vhCDR1
DAWMD

SEQ ID NO: 32117 - protein, 19 aa, Artificial Sequence
  Description of Artificial Sequence: Synthetic peptide
  XENP021704 vhCDR2
EIRTKANNHATYYAESVKG

SEQ ID NO: 32118 - protein, 10 aa, Artificial Sequence
  Description of Artificial Sequence: Synthetic peptide
  XENP021704 vhCDR3
LANWDWYFDV

SEQ ID NO: 32119 - protein, 218 aa, Artificial Sequence; identical to SEQ ID NO: 31979
  Description of Artificial Sequence: Synthetic polypeptide
  XENP021704 7G8_H3_L1.15_Fab Light Chain

SEQ ID NO: 32120 - protein, 111 aa, Artificial Sequence; identical to SEQ ID NO: 31980
  Description of Artificial Sequence: Synthetic polypeptide
  VL of XENP021704

SEQ ID NO: 32121 - protein, 15 aa, Artificial Sequence
  Description of Artificial Sequence: Synthetic peptide
  XENP021704 vlCDR1
RASQSVDHDDDSYMN

SEQ ID NO: 32122 - protein, 7 aa, Artificial Sequence
  Description of Artificial Sequence: Synthetic peptide
  XENP021704 vlCDR2
AASELES

SEQ ID NO: 32123 - protein, 9 aa, Artificial Sequence
  Description of Artificial Sequence: Synthetic peptide
  XENP021704 vlCDR3
QQSNEDPFT

SEQ ID NO: 32124 - protein, 226 aa, Artificial Sequence
  Description of Artificial Sequence: Synthetic polypeptide
  XENP021742 7G8_H3.11_L1.13_Fab Heavy Chain
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32125 - protein, 121 aa, Artificial Sequence
  Description of Artificial Sequence: Synthetic polypeptide
  VH of XENP021742
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLANWDWYFDVWGQGTTVTVSS

SEQ ID NO: 32126 - protein, 5 aa, Artificial Sequence
  Description of Artificial Sequence: Synthetic peptide
  XENP021742 vhCDR1
DAWMD

SEQ ID NO: 32127 - protein, 19 aa, Artificial Sequence
  Description of Artificial Sequence: Synthetic peptide
  XENP021742 vhCDR2
EISTKANNHATYYAESVKG

SEQ ID NO: 32128 - protein, 10 aa, Artificial Sequence
  Description of Artificial Sequence: Synthetic peptide
  XENP021742 vhCDR3
LANWDWYFDV

SEQ ID NO: 32129 - protein, 218 aa, Artificial Sequence; identical to SEQ ID NO: 22419
  Description of Artificial Sequence: Synthetic polypeptide
  XENP021742 7G8_H3.11_L1.13_Fab Light Chain

SEQ ID NO: 32130 - protein, 111 aa, Artificial Sequence; identical to SEQ ID NO: 22420
  Description of Artificial Sequence: Synthetic polypeptide
  VL of XENP021742

SEQ ID NO: 32131 - protein, 15 aa, Artificial Sequence
  Description of Artificial Sequence: Synthetic peptide
  XENP021742 vlCDR1
RASQSVDHDGDSYMN

SEQ ID NO: 32132 - protein, 7 aa, Artificial Sequence
  Description of Artificial Sequence: Synthetic peptide
  XENP021742 vlCDR2
AASELES

SEQ ID NO: 32133 - protein, 9 aa, Artificial Sequence
  Description of Artificial Sequence: Synthetic peptide
  XENP021742 vlCDR3
QQSNEDPFT

SEQ ID NO: 32134 - protein, 226 aa, Artificial Sequence; identical to SEQ ID NO: 28974
  Description of Artificial Sequence: Synthetic polypeptide
  XENP021743 7G8_H3.4_L1.13_Fab Heavy Chain

SEQ ID NO: 32135 - protein, 121 aa, Artificial Sequence; identical to SEQ ID NO: 28975
  Description of Artificial Sequence: Synthetic polypeptide
  VH of XENP021743

SEQ ID NO: 32136 - protein, 5 aa, Artificial Sequence
  Description of Artificial Sequence: Synthetic peptide
  XENP021743 vhCDR1
DAWMD

SEQ ID NO: 32137 - protein, 19 aa, Artificial Sequence
  Description of Artificial Sequence: Synthetic peptide
  XENP021743 vhCDR2
EIRTKANNHATYYAESVKG

SEQ ID NO: 32138 - protein, 10 aa, Artificial Sequence
  Description of Artificial Sequence: Synthetic peptide
  XENP021743 vhCDR3
LATWDWYFDV

SEQ ID NO: 32139 - protein, 218 aa, Artificial Sequence; identical to SEQ ID NO: 22419
  Description of Artificial Sequence: Synthetic polypeptide
  XENP021743 7G8_H3.4_L1.13_Fab Light Chain

SEQ ID NO: 32140 - protein, 111 aa, Artificial Sequence; identical to SEQ ID NO: 22420
  Description of Artificial Sequence: Synthetic polypeptide
  VL of XENP021743

SEQ ID NO: 32141 - protein, 15 aa, Artificial Sequence
  Description of Artificial Sequence: Synthetic peptide
  XENP021743 vlCDR1
RASQSVDHDGDSYMN

SEQ ID NO: 32142 - protein, 7 aa, Artificial Sequence
  Description of Artificial Sequence: Synthetic peptide
  XENP021743 vlCDR2
AASELES

SEQ ID NO: 32143 - protein, 9 aa, Artificial Sequence
  Description of Artificial Sequence: Synthetic peptide
  XENP021743 vlCDR3
QQSNEDPFT

SEQ ID NO: 32144 - protein, 226 aa, Artificial Sequence; identical to SEQ ID NO: 28944
  Description of Artificial Sequence: Synthetic polypeptide
  XENP021744 7G8_H3.1_L1.13_Fab Heavy Chain

SEQ ID NO: 32145 - protein, 121 aa, Artificial Sequence; identical to SEQ ID NO: 28945
  Description of Artificial Sequence: Synthetic polypeptide
  VH of XENP021744

SEQ ID NO: 32146 - protein, 5 aa, Artificial Sequence
  Description of Artificial Sequence: Synthetic peptide
  XENP021744 vhCDR1
DAWMD

SEQ ID NO: 32147 - protein, 19 aa, Artificial Sequence
  Description of Artificial Sequence: Synthetic peptide
  XENP021744 vhCDR2
EIRTKANNHATYYAESVKG

SEQ ID NO: 32148 - protein, 10 aa, Artificial Sequence
  Description of Artificial Sequence: Synthetic peptide
  XENP021744 vhCDR3
LATWDWYFDV

SEQ ID NO: 32149 - protein, 218 aa, Artificial Sequence; identical to SEQ ID NO: 22419
  Description of Artificial Sequence: Synthetic polypeptide
  XENP021744 7G8_H3.1_L1.13_Fab Light Chain

SEQ ID NO: 32150 - protein, 111 aa, Artificial Sequence; identical to SEQ ID NO: 22420
  Description of Artificial Sequence: Synthetic polypeptide
  VL of XENP021744

SEQ ID NO: 32151 - protein, 15 aa, Artificial Sequence
  Description of Artificial Sequence: Synthetic peptide
  XENP021744 vlCDR1
RASQSVDHDGDSYMN

SEQ ID NO: 32152 - protein, 7 aa, Artificial Sequence
  Description of Artificial Sequence: Synthetic peptide
  XENP021744 vlCDR2
AASELES

SEQ ID NO: 32153 - protein, 9 aa, Artificial Sequence
  Description of Artificial Sequence: Synthetic peptide
  XENP021744 vlCDR3
QQSNEDPFT

SEQ ID NO: 32154 - protein, 226 aa, Artificial Sequence; identical to SEQ ID NO: 32124
  Description of Artificial Sequence: Synthetic polypeptide
  XENP021745 7G8_H3.11_L1.15_Fab Heavy Chain

SEQ ID NO: 32155 - protein, 121 aa, Artificial Sequence; identical to SEQ ID NO: 32125
  Description of Artificial Sequence: Synthetic polypeptide
  VH of XENP021745

SEQ ID NO: 32156 - protein, 5 aa, Artificial Sequence
  Description of Artificial Sequence: Synthetic peptide
  XENP021745 vhCDR1
DAWMD

SEQ ID NO: 32157 - protein, 19 aa, Artificial Sequence
  Description of Artificial Sequence: Synthetic peptide
  XENP021745 vhCDR2
EISTKANNHATYYAESVKG

SEQ ID NO: 32158 - protein, 10 aa, Artificial Sequence
  Description of Artificial Sequence: Synthetic peptide
  XENP021745 vhCDR3
LANWDWYFDV

SEQ ID NO: 32159 - protein, 218 aa, Artificial Sequence; identical to SEQ ID NO: 31979
  Description of Artificial Sequence: Synthetic polypeptide
  XENP021745 7G8_H3.11_L1.15_Fab Light Chain

SEQ ID NO: 32160 - protein, 111 aa, Artificial Sequence; identical to SEQ ID NO: 31980
  Description of Artificial Sequence: Synthetic polypeptide
  VL of XENP021745

SEQ ID NO: 32161 - protein, 15 aa, Artificial Sequence
  Description of Artificial Sequence: Synthetic peptide
  XENP021745 vlCDR1
RASQSVDHDDDSYMN

SEQ ID NO: 32162 - protein, 7 aa, Artificial Sequence
  Description of Artificial Sequence: Synthetic peptide
  XENP021745 vlCDR2
AASELES

SEQ ID NO: 32163 - protein, 9 aa, Artificial Sequence
  Description of Artificial Sequence: Synthetic peptide
  XENP021745 vlCDR3
QQSNEDPFT

SEQ ID NO: 32164 - protein, 226 aa, Artificial Sequence; identical to SEQ ID NO: 28974
  Description of Artificial Sequence: Synthetic polypeptide
  XENP021746 7G8_H3.4_L1.15_Fab Heavy Chain

SEQ ID NO: 32165 - protein, 121 aa, Artificial Sequence; identical to SEQ ID NO: 28975
  Description of Artificial Sequence: Synthetic polypeptide
  VH of XENP021746

SEQ ID NO: 32166 - protein, 5 aa, Artificial Sequence
  Description of Artificial Sequence: Synthetic peptide
  XENP021746 vhCDR1
DAWMD

SEQ ID NO: 32167 - protein, 19 aa, Artificial Sequence
  Description of Artificial Sequence: Synthetic peptide
  XENP021746 vhCDR2
EIRTKANNHATYYAESVKG

SEQ ID NO: 32168 - protein, 10 aa, Artificial Sequence
  Description of Artificial Sequence: Synthetic peptide
  XENP021746 vhCDR3
LATWDWYFDV

SEQ ID NO: 32169 - protein, 218 aa, Artificial Sequence; identical to SEQ ID NO: 31979
  Description of Artificial Sequence: Synthetic polypeptide
  XENP021746 7G8_H3.4_L1.15_Fab Light Chain

SEQ ID NO: 32170 - protein, 111 aa, Artificial Sequence; identical to SEQ ID NO: 31980
  Description of Artificial Sequence: Synthetic polypeptide
  VL of XENP021746

SEQ ID NO: 32171 - protein, 15 aa, Artificial Sequence
  Description of Artificial Sequence: Synthetic peptide
  XENP021746 vlCDR1
RASQSVDHDDDSYMN

SEQ ID NO: 32172 - protein, 7 aa, Artificial Sequence
  Description of Artificial Sequence: Synthetic peptide
  XENP021746 vlCDR2
AASELES

SEQ ID NO: 32173 - protein, 9 aa, Artificial Sequence
  Description of Artificial Sequence: Synthetic peptide
  XENP021746 vlCDR3
QQSNEDPFT

SEQ ID NO: 32174 - protein, 226 aa, Artificial Sequence; identical to SEQ ID NO: 28944
  Description of Artificial Sequence: Synthetic polypeptide
  XENP021747 7G8_H3.1_L1.15_Fab Heavy Chain

SEQ ID NO: 32175 - protein, 121 aa, Artificial Sequence; identical to SEQ ID NO: 28945
  Description of Artificial Sequence: Synthetic polypeptide
  VH of XENP021747

SEQ ID NO: 32176 - protein, 5 aa, Artificial Sequence
  Description of Artificial Sequence: Synthetic peptide
  XENP021747 vhCDR1
DAWMD

SEQ ID NO: 32177 - protein, 19 aa, Artificial Sequence
  Description of Artificial Sequence: Synthetic peptide
  XENP021747 vhCDR2
EIRTKANNHATYYAESVKG

SEQ ID NO: 32178 - protein, 10 aa, Artificial Sequence
  Description of Artificial Sequence: Synthetic peptide
  XENP021747 vhCDR3
LATWDWYFDV

SEQ ID NO: 32179 - protein, 218 aa, Artificial Sequence; identical to SEQ ID NO: 31979
  Description of Artificial Sequence: Synthetic polypeptide
  XENP021747 7G8_H3.1_L1.15_Fab Light Chain

SEQ ID NO: 32180 - protein, 111 aa, Artificial Sequence; identical to SEQ ID NO: 31980
  Description of Artificial Sequence: Synthetic polypeptide
  VL of XENP021747

SEQ ID NO: 32181 - protein, 15 aa, Artificial Sequence
  Description of Artificial Sequence: Synthetic peptide
  XENP021747 vlCDR1
RASQSVDHDDDSYMN

SEQ ID NO: 32182 - protein, 7 aa, Artificial Sequence
  Description of Artificial Sequence: Synthetic peptide
  XENP021747 vlCDR2
AASELES

SEQ ID NO: 32183 - protein, 9 aa, Artificial Sequence
  Description of Artificial Sequence: Synthetic peptide
  XENP021747 vlCDR3
QQSNEDPFT

SEQ ID NO: 32184 - protein, 226 aa, Artificial Sequence
  Description of Artificial Sequence: Synthetic polypeptide
  XENP021889 7G8_H3.27_L1_Fab Heavy Chain
EVQLVESGGGLVQPGGSLRLSCAASGDTFDDAWMDWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGS

SEQ ID NO: 32185 - protein, 121 aa, Artificial Sequence
  Description of Artificial Sequence: Synthetic polypeptide
  VH of XENP021889
EVQLVESGGGLVQPGGSLRLSCAASGDTFDDAWMDWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 32186 - protein, 5 aa, Artificial Sequence
  Description of Artificial Sequence: Synthetic peptide
  XENP021889 vhCDR1
DAWMD

SEQ ID NO: 32187 - protein, 19 aa, Artificial Sequence
  Description of Artificial Sequence: Synthetic peptide
  XENP021889 vhCDR2
EISTKAYNHATYYAESVKG

SEQ ID NO: 32188 - protein, 10 aa, Artificial Sequence
  Description of Artificial Sequence: Synthetic peptide
  XENP021889 vhCDR3
LATWDWYFDV

SEQ ID NO: 32189 - protein, 218 aa, Artificial Sequence; identical to SEQ ID NO: 17600
  Description of Artificial Sequence: Synthetic polypeptide
  XENP021889 7G8_H3.27_L1_Fab Light Chain

SEQ ID NO: 32190 - protein, 111 aa, Artificial Sequence; identical to SEQ ID NO: 17601
  Description of Artificial Sequence: Synthetic polypeptide
  VL of XENP021889

SEQ ID NO: 32191 - protein, 15 aa, Artificial Sequence
  Description of Artificial Sequence: Synthetic peptide
  XENP021889 vlCDR1
RASQSVDYDGDSYMN

SEQ ID NO: 32192 - protein, 7 aa, Artificial Sequence
  Description of Artificial Sequence: Synthetic peptide
  XENP021889 vlCDR2
AASNLES

SEQ ID NO: 32193 - protein, 9 aa, Artificial Sequence
  Description of Artificial Sequence: Synthetic peptide
  XENP021889 vlCDR3
QQSNEDPFT

SEQ ID NO: 32194 - protein, 226 aa, Artificial Sequence; identical to SEQ ID NO: 32184
  Description of Artificial Sequence: Synthetic polypeptide
  XENP021890 7G8_H3.27_L1.11_Fab Heavy Chain

SEQ ID NO: 32195 - protein, 121 aa, Artificial Sequence; identical to SEQ ID NO: 32185
  Description of Artificial Sequence: Synthetic polypeptide
  VH of XENP021890

SEQ ID NO: 32196 - protein, 5 aa, Artificial Sequence
  Description of Artificial Sequence: Synthetic peptide
  XENP021890 vhCDR1
DAWMD

SEQ ID NO: 32197 - protein, 19 aa, Artificial Sequence
  Description of Artificial Sequence: Synthetic peptide
  XENP021890 vhCDR2
EISTKAYNHATYYAESVKG

SEQ ID NO: 32198 - protein, 10 aa, Artificial Sequence
  Description of Artificial Sequence: Synthetic peptide
  XENP021890 vhCDR3
LATWDWYFDV

SEQ ID NO: 32199 - protein, 218 aa, Artificial Sequence; identical to SEQ ID NO: 22359
  Description of Artificial Sequence: Synthetic polypeptide
  XENP021890 7G8_H3.27_L1.11_Fab Light Chain

SEQ ID NO: 32200 - protein, 111 aa, Artificial Sequence; identical to SEQ ID NO: 22360
  Description of Artificial Sequence: Synthetic polypeptide
  VL of XENP021890

SEQ ID NO: 32201 - protein, 15 aa, Artificial Sequence
  Description of Artificial Sequence: Synthetic peptide
  XENP021890 vlCDR1
RASQSVDYDGDSYMN

SEQ ID NO: 32202 - protein, 7 aa, Artificial Sequence
  Description of Artificial Sequence: Synthetic peptide
  XENP021890 vlCDR2
AASELES

SEQ ID NO: 32203 - protein, 9 aa, Artificial Sequence
  Description of Artificial Sequence: Synthetic peptide
  XENP021890 vlCDR3
QQSNEDPFT

SEQ ID NO: 32204 - protein, 226 aa, Artificial Sequence; identical to SEQ ID NO: 32184
  Description of Artificial Sequence: Synthetic polypeptide
  XENP021891 7G8_H3.27_L1.13_Fab Heavy Chain

SEQ ID NO: 32205 - protein, 121 aa, Artificial Sequence; identical to SEQ ID NO: 32185
  Description of Artificial Sequence: Synthetic polypeptide
  VH of XENP021891

SEQ ID NO: 32206 - protein, 5 aa, Artificial Sequence
  Description of Artificial Sequence: Synthetic peptide
  XENP021891 vhCDR1
DAWMD

SEQ ID NO: 32207 - protein, 19 aa, Artificial Sequence
  Description of Artificial Sequence: Synthetic peptide
  XENP021891 vhCDR2
EISTKAYNHATYYAESVKG

SEQ ID NO: 32208 - protein, 10 aa, Artificial Sequence
  Description of Artificial Sequence: Synthetic peptide
  XENP021891 vhCDR3
LATWDWYFDV

SEQ ID NO: 32209 - protein, 218 aa, Artificial Sequence; identical to SEQ ID NO: 22419
  Description of Artificial Sequence: Synthetic polypeptide
  XENP021891 7G8_H3.27_L1.13_Fab Light Chain

SEQ ID NO: 32210 - protein, 111 aa, Artificial Sequence; identical to SEQ ID NO: 22420
  Description of Artificial Sequence: Synthetic polypeptide
  VL of XENP021891

SEQ ID NO: 32211 - protein, 15 aa, Artificial Sequence
  Description of Artificial Sequence: Synthetic peptide
  XENP021891 vlCDR1
RASQSVDHDGDSYMN

SEQ ID NO: 32212 - protein, 7 aa, Artificial Sequence
  Description of Artificial Sequence: Synthetic peptide
  XENP021891 vlCDR2
AASELES

SEQ ID NO: 32213 - protein, 9 aa, Artificial Sequence
  Description of Artificial Sequence: Synthetic peptide
  XENP021891 vlCDR3
QQSNEDPFT

SEQ ID NO: 32214 - protein, 226 aa, Artificial Sequence
  Description of Artificial Sequence: Synthetic polypeptide
  XENP021892 7G8_H3.28_L1_Fab Heavy Chain
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGS

SEQ ID NO: 32215 - protein, 121 aa, Artificial Sequence; identical to SEQ ID NO: 22425
  Description of Artificial Sequence: Synthetic polypeptide
  VH of XENP021892

SEQ ID NO: 32216 - protein, 5 aa, Artificial Sequence
  Description of Artificial Sequence: Synthetic peptide
  XENP021892 vhCDR1
DAWMD

SEQ ID NO: 32217 - protein, 19 aa, Artificial Sequence
  Description of Artificial Sequence: Synthetic peptide
  XENP021892 vhCDR2
EISTKAYNHATYYAESVKG

SEQ ID NO: 32218 - protein, 10 aa, Artificial Sequence
  Description of Artificial Sequence: Synthetic peptide
  XENP021892 vhCDR3
LATWDWYFDV

SEQ ID NO: 32219 - protein, 218 aa, Artificial Sequence; identical to SEQ ID NO: 17600
  Description of Artificial Sequence: Synthetic polypeptide
  XENP021892 7G8_H3.28_L1_Fab Light Chain

SEQ ID NO: 32220 - protein, 111 aa, Artificial Sequence; identical to SEQ ID NO: 17601
  Description of Artificial Sequence: Synthetic polypeptide
  VL of XENP021892

SEQ ID NO: 32221 - protein, 15 aa, Artificial Sequence
  Description of Artificial Sequence: Synthetic peptide
  XENP021892 vlCDR1
RASQSVDYDGDSYMN

SEQ ID NO: 32222 - protein, 7 aa, Artificial Sequence
  Description of Artificial Sequence: Synthetic peptide
  XENP021892 vlCDR2
AASNLES

SEQ ID NO: 32223 - protein, 9 aa, Artificial Sequence
  Description of Artificial Sequence: Synthetic peptide
  XENP021892 vlCDR3
QQSNEDPFT

SEQ ID NO: 32224 - protein, 226 aa, Artificial Sequence; identical to SEQ ID NO: 32214
  Description of Artificial Sequence: Synthetic polypeptide
  XENP021893 7G8_H3.28_L1.11_Fab Heavy Chain

SEQ ID NO: 32225 - protein, 121 aa, Artificial Sequence; identical to SEQ ID NO: 22425
  Description of Artificial Sequence: Synthetic polypeptide
  VH of XENP021893

SEQ ID NO: 32226 - protein, 5 aa, Artificial Sequence
  Description of Artificial Sequence: Synthetic peptide
  XENP021893 vhCDR1
DAWMD

SEQ ID NO: 32227 - protein, 19 aa, Artificial Sequence
  Description of Artificial Sequence: Synthetic peptide
  XENP021893 vhCDR2
EISTKAYNHATYYAESVKG

SEQ ID NO: 32228 - protein, 10 aa, Artificial Sequence
  Description of Artificial Sequence: Synthetic peptide
  XENP021893 vhCDR3
LATWDWYFDV

SEQ ID NO: 32229 - protein, 218 aa, Artificial Sequence; identical to SEQ ID NO: 22359
  Description of Artificial Sequence: Synthetic polypeptide
  XENP021893 7G8_H3.28_L1.11_Fab Light Chain

SEQ ID NO: 32230 - protein, 111 aa, Artificial Sequence; identical to SEQ ID NO: 22360
  Description of Artificial Sequence: Synthetic polypeptide
  VL of XENP021893

SEQ ID NO: 32231 - protein, 15 aa, Artificial Sequence
  Description of Artificial Sequence: Synthetic peptide
  XENP021893 vlCDR1
RASQSVDYDGDSYMN

SEQ ID NO: 32232 - protein, 7 aa, Artificial Sequence
  Description of Artificial Sequence: Synthetic peptide
  XENP021893 vlCDR2
AASELES

SEQ ID NO: 32233 - protein, 9 aa, Artificial Sequence
  Description of Artificial Sequence: Synthetic peptide
  XENP021893 vlCDR3
QQSNEDPFT

SEQ ID NO: 32234 - protein, 226 aa, Artificial Sequence; identical to SEQ ID NO: 32214
  Description of Artificial Sequence: Synthetic polypeptide
  XENP021894 7G8_H3.28_L1.13_Fab Heavy Chain

SEQ ID NO: 32235 - protein, 121 aa, Artificial Sequence; identical to SEQ ID NO: 22425
  Description of Artificial Sequence: Synthetic polypeptide
  VH of XENP021894

SEQ ID NO: 32236 - protein, 5 aa, Artificial Sequence
  Description of Artificial Sequence: Synthetic peptide
  XENP021894 vhCDR1
DAWMD

SEQ ID NO: 32237 - protein, 19 aa, Artificial Sequence
  Description of Artificial Sequence: Synthetic peptide
  XENP021894 vhCDR2
EISTKAYNHATYYAESVKG

SEQ ID NO: 32238 - protein, 10 aa, Artificial Sequence
  Description of Artificial Sequence: Synthetic peptide
  XENP021894 vhCDR3
LATWDWYFDV

SEQ ID NO: 32239 - protein, 218 aa, Artificial Sequence; identical to SEQ ID NO: 22419
  Description of Artificial Sequence: Synthetic polypeptide
  XENP021894 7G8_H3.28_L1.13_Fab Light Chain

SEQ ID NO: 32240 - protein, 111 aa, Artificial Sequence; identical to SEQ ID NO: 22420
  Description of Artificial Sequence: Synthetic polypeptide
  VL of XENP021894

SEQ ID NO: 32241 - protein, 15 aa, Artificial Sequence
  Description of Artificial Sequence: Synthetic peptide
  XENP021894 vlCDR1
RASQSVDHDGDSYMN

SEQ ID NO: 32242 - protein, 7 aa, Artificial Sequence
  Description of Artificial Sequence: Synthetic peptide
  XENP021894 vlCDR2
AASELES

SEQ ID NO: 32243 - protein, 9 aa, Artificial Sequence
  Description of Artificial Sequence: Synthetic peptide
  XENP021894 vlCDR3
QQSNEDPFT

SEQ ID NO: 32244 - protein, 226 aa, Artificial Sequence
  Description of Artificial Sequence: Synthetic polypeptide
  XENP022379 7G8_H3.29_L1.11_Fab Heavy Chain
EVQLVESGGGLVQPGGSLRLSCAASGFTFDDAWMHWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32245 - protein, 121 aa, Artificial Sequence
  Description of Artificial Sequence: Synthetic polypeptide
  VH of XENP022379
EVQLVESGGGLVQPGGSLRLSCAASGFTFDDAWMHWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32246 - protein, 5 aa, Artificial Sequence
  Description of Artificial Sequence: Synthetic peptide
  XENP022379 vhCDR1
DAWMH

SEQ ID NO: 32247 - protein, 19 aa, Artificial Sequence
  Description of Artificial Sequence: Synthetic peptide
  XENP022379 vhCDR2
EISTKANNHATYYAESVKG

SEQ ID NO: 32248 - protein, 10 aa, Artificial Sequence
  Description of Artificial Sequence: Synthetic peptide
  XENP022379 vhCDR3
LATWDWYFDV

SEQ ID NO: 32249 - protein, 218 aa, Artificial Sequence; identical to SEQ ID NO: 22359
  Description of Artificial Sequence: Synthetic polypeptide
  XENP022379 7G8_H3.29_L1.11_Fab Light Chain

SEQ ID NO: 32250 - protein, 111 aa, Artificial Sequence; identical to SEQ ID NO: 22360
  Description of Artificial Sequence: Synthetic polypeptide
  VL of XENP022379

SEQ ID NO: 32251 - protein, 15 aa, Artificial Sequence
  Description of Artificial Sequence: Synthetic peptide
  XENP022379 vlCDR1
RASQSVDYDGDSYMN

SEQ ID NO: 32252 - protein, 7 aa, Artificial Sequence
  Description of Artificial Sequence: Synthetic peptide
  XENP022379 vlCDR2
AASELES

SEQ ID NO: 32253 - protein, 9 aa, Artificial Sequence
  Description of Artificial Sequence: Synthetic peptide
  XENP022379 vlCDR3
QQSNEDPFT

SEQ ID NO: 32254 - protein, 226 aa, Artificial Sequence
  Description of Artificial Sequence: Synthetic polypeptide
  XENP022380 7G8_H3.30_L1.11_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32255 - protein, 121 aa, Artificial Sequence; identical to SEQ ID NO: 22485
  Description of Artificial Sequence: Synthetic polypeptide
  VH of XENP022380

SEQ ID NO: 32256 - protein, 5 aa, Artificial Sequence
  Description of Artificial Sequence: Synthetic peptide
  XENP022380 vhCDR1
DAWMS

SEQ ID NO: 32257 - protein, 19 aa, Artificial Sequence
  Description of Artificial Sequence: Synthetic peptide
  XENP022380 vhCDR2
EISTKANNHATYYAESVKG

SEQ ID NO: 32258 - protein, 10 aa, Artificial Sequence
  Description of Artificial Sequence: Synthetic peptide
  XENP022380 vhCDR3
LATWDWYFDV

SEQ ID NO: 32259 - protein, 218 aa, Artificial Sequence; identical to SEQ ID NO: 22359
  Description of Artificial Sequence: Synthetic polypeptide
  XENP022380 7G8_H3.30_L1.11_Fab Light Chain

SEQ ID NO: 32260 - protein, 111 aa, Artificial Sequence; identical to SEQ ID NO: 22360
  Description of Artificial Sequence: Synthetic polypeptide
  VL of XENP022380

SEQ ID NO: 32261 - protein, 15 aa, Artificial Sequence
  Description of Artificial Sequence: Synthetic peptide
  XENP022380 vlCDR1
RASQSVDYDGDSYMN

SEQ ID NO: 32262 - protein, 7 aa, Artificial Sequence
  Description of Artificial Sequence: Synthetic peptide
  XENP022380 vlCDR2
AASELES

SEQ ID NO: 32263 - protein, 9 aa, Artificial Sequence
  Description of Artificial Sequence: Synthetic peptide
  XENP022380 vlCDR3
QQSNEDPFT

SEQ ID NO: 32264 - protein, 226 aa, Artificial Sequence
  Description of Artificial Sequence: Synthetic polypeptide
  XENP022381 7G8_H3.31_L1.11_Fab Heavy Chain
EVQLVESGGGLVQPGGSLRLSCAASGFTFDDAWMNWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32265 - protein, 121 aa, Artificial Sequence
  Description of Artificial Sequence: Synthetic polypeptide
  VH of XENP022381
EVQLVESGGGLVQPGGSLRLSCAASGFTFDDAWMNWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32266 - protein, 5 aa, Artificial Sequence
  Description of Artificial Sequence: Synthetic peptide
  XENP022381 vhCDR1
DAWMN

SEQ ID NO: 32267 - protein, 19 aa, Artificial Sequence
  Description of Artificial Sequence: Synthetic peptide
  XENP022381 vhCDR2
EISTKANNHATYYAESVKG

SEQ ID NO: 32268 - protein, 10 aa, Artificial Sequence
  Description of Artificial Sequence: Synthetic peptide
  XENP022381 vhCDR3
LATWDWYFDV

SEQ ID NO: 32269 - protein, 218 aa, Artificial Sequence; identical to SEQ ID NO: 22359
  Description of Artificial Sequence: Synthetic polypeptide
  XENP022381 7G8_H3.31_L1.11_Fab Light Chain

SEQ ID NO: 32270 - protein, 111 aa, Artificial Sequence; identical to SEQ ID NO: 22360
  Description of Artificial Sequence: Synthetic polypeptide
  VL of XENP022381

SEQ ID NO: 32271 - protein, 15 aa, Artificial Sequence
  Description of Artificial Sequence: Synthetic peptide
  XENP022381 vlCDR1
RASQSVDYDGDSYMN

SEQ ID NO: 32272 - protein, 7 aa, Artificial Sequence
  Description of Artificial Sequence: Synthetic peptide
  XENP022381 vlCDR2
AASELES

SEQ ID NO: 32273 - protein, 9 aa, Artificial Sequence
  Description of Artificial Sequence: Synthetic peptide
  XENP022381 vlCDR3
QQSNEDPFT

SEQ ID NO: 32274 - protein, 226 aa, Artificial Sequence
  Description of Artificial Sequence: Synthetic polypeptide
  XENP022382 7G8_H3.32_L1.11_Fab Heavy Chain
EVQLVESGGGLVQPGGSLRLSCAASGFTFDDAWMQWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32275 - protein, 121 aa, Artificial Sequence
  Description of Artificial Sequence: Synthetic polypeptide
  VH of XENP022382
EVQLVESGGGLVQPGGSLRLSCAASGFTFDDAWMQWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 32276 - protein, 5 aa, Artificial Sequence
  Description of Artificial Sequence: Synthetic peptide
  XENP022382 vhCDR1
DAWMQ

SEQ ID NO: 32277 - protein, 19 aa, Artificial Sequence
  Description of Artificial Sequence: Synthetic peptide
  XENP022382 vhCDR2
EISTKANNHATYYAESVKG

SEQ ID NO: 32278 - protein, 10 aa, Artificial Sequence
  Description of Artificial Sequence: Synthetic peptide
  XENP022382 vhCDR3
LATWDWYFDV

SEQ ID NO: 32279 - protein, 218 aa, Artificial Sequence; identical to SEQ ID NO: 22359
  Description of Artificial Sequence: Synthetic polypeptide
  XENP022382 7G8_H3.32_L1.11_Fab Light Chain

SEQ ID NO: 32280 - protein, 111 aa, Artificial Sequence; identical to SEQ ID NO: 22360
  Description of Artificial Sequence: Synthetic polypeptide
  VL of XENP022382

SEQ ID NO: 32281 - protein, 15 aa, Artificial Sequence
  Description of Artificial Sequence: Synthetic peptide
  XENP022382 vlCDR1
RASQSVDYDGDSYMN

SEQ ID NO: 32282 - protein, 7 aa, Artificial Sequence
  Description of Artificial Sequence: Synthetic peptide
  XENP022382 vlCDR2
AASELES

SEQ ID NO: 32283 - protein, 9 aa, Artificial Sequence
  Description of Artificial Sequence: Synthetic peptide
  XENP022382 vlCDR3
QQSNEDPFT

SEQ ID NO: 32284 - protein, 226 aa, Artificial Sequence
  Description of Artificial Sequence: Synthetic polypeptide
  XENP022383 7G8_H3.33_L1.11_Fab Heavy Chain
EVQLVESGGGLVQPGGSLRLSCAASGFTFDDAWMGWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32285 - protein, 121 aa, Artificial Sequence; identical to SEQ ID NO: 22505
  Description of Artificial Sequence: Synthetic polypeptide
  VH of XENP022383

SEQ ID NO: 32286 - protein, 5 aa, Artificial Sequence
  Description of Artificial Sequence: Synthetic peptide
  XENP022383 vhCDR1
DAWMG

SEQ ID NO: 32287 - protein, 19 aa, Artificial Sequence
  Description of Artificial Sequence: Synthetic peptide
  XENP022383 vhCDR2
EISTKANNHATYYAESVKG

SEQ ID NO: 32288 - protein, 10 aa, Artificial Sequence
  Description of Artificial Sequence: Synthetic peptide
  XENP022383 vhCDR3
LATWDWYFDV

SEQ ID NO: 32289 - protein, 218 aa, Artificial Sequence; identical to SEQ ID NO: 22359
  Description of Artificial Sequence: Synthetic polypeptide
  XENP022383 7G8_H3.33_L1.11_Fab Light Chain

SEQ ID NO: 32290 - protein, 111 aa, Artificial Sequence; identical to SEQ ID NO: 22360
  Description of Artificial Sequence: Synthetic polypeptide
  VL of XENP022383

SEQ ID NO: 32291 - protein, 15 aa, Artificial Sequence
  Description of Artificial Sequence: Synthetic peptide
  XENP022383 vlCDR1
RASQSVDYDGDSYMN

SEQ ID NO: 32292 - protein, 7 aa, Artificial Sequence
  Description of Artificial Sequence: Synthetic peptide
  XENP022383 vlCDR2
AASELES

SEQ ID NO: 32293 - protein, 9 aa, Artificial Sequence
  Description of Artificial Sequence: Synthetic peptide
  XENP022383 vlCDR3
QQSNEDPFT

SEQ ID NO: 32294 - protein, 226 aa, Artificial Sequence
  Description of Artificial Sequence: Synthetic polypeptide
  XENP022384 7G8_H3.34_L1.11_Fab Heavy Chain
EVQLVESGGGLVQPGGSLRLSCAASGFTFDDAWMDWVRQAPGKGLEWVAEISTKANNHATYYAQSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32295 - protein, 121 aa, Artificial Sequence
  Description of Artificial Sequence: Synthetic polypeptide
  VH of XENP022384
EVQLVESGGGLVQPGGSLRLSCAASGFTFDDAWMDWVRQAPGKGLEWVAEISTKANNHATYYAQSVKGRFTISRDDSKSSVYLQMNSLRAEDTAVYYCTRLATWDWYFDVWGQGTTVTVSS

SEQ ID NO: 32296 - protein, 5 aa, Artificial Sequence
  Description of Artificial Sequence: Synthetic peptide
  XENP022384 vhCDR1
DAWMD

SEQ ID NO: 32297 - protein, 19 aa, Artificial Sequence
  Description of Artificial Sequence: Synthetic peptide
  XENP022384 vhCDR2
EISTKANNHATYYAQSVKG

SEQ ID NO: 32298 - protein, 10 aa, Artificial Sequence
  Description of Artificial Sequence: Synthetic peptide
  XENP022384 vhCDR3
LATWDWYFDV

SEQ ID NO: 32299 - protein, 218 aa, Artificial Sequence; identical to SEQ ID NO: 22359
  Description of Artificial Sequence: Synthetic polypeptide
  XENP022384 7G8_H3.34_L1.11_Fab Light Chain

SEQ ID NO: 32300 - protein, 111 aa, Artificial Sequence; identical to SEQ ID NO: 22360
  Description of Artificial Sequence: Synthetic polypeptide
  VL of XENP022384

SEQ ID NO: 32301 - protein, 15 aa, Artificial Sequence
  Description of Artificial Sequence: Synthetic peptide
  XENP022384 vlCDR1
RASQSVDYDGDSYMN

SEQ ID NO: 32302 - protein, 7 aa, Artificial Sequence
  Description of Artificial Sequence: Synthetic peptide
  XENP022384 vlCDR2
AASELES

SEQ ID NO: 32303 - protein, 9 aa, Artificial Sequence
  Description of Artificial Sequence: Synthetic peptide
  XENP022384 vlCDR3
QQSNEDPFT

SEQ ID NO: 32304 - protein, 226 aa, Artificial Sequence
  Description of Artificial Sequence: Synthetic polypeptide
  XENP022385 7G8_H3.35_L1.11_Fab Heavy Chain
EVQLVESGGGLVQPGGSLRLSCAASGFTFDDAWMDWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32305 - protein, 121 aa, Artificial Sequence
  Description of Artificial Sequence: Synthetic polypeptide
  VH of XENP022385
EVQLVESGGGLVQPGGSLRLSCAASGFTFDDAWMDWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32306 - protein, 5 aa, Artificial Sequence
  Description of Artificial Sequence: Synthetic peptide
  XENP022385 vhCDR1
DAWMD

SEQ ID NO: 32307 - protein, 19 aa, Artificial Sequence
  Description of Artificial Sequence: Synthetic peptide
  XENP022385 vhCDR2
EISTKANNHATYYAPSVKG

SEQ ID NO: 32308 - protein, 10 aa, Artificial Sequence
  Description of Artificial Sequence: Synthetic peptide
  XENP022385 vhCDR3
LATWDWYFDV

SEQ ID NO: 32309 - protein, 218 aa, Artificial Sequence; identical to SEQ ID NO: 22359
  Description of Artificial Sequence: Synthetic polypeptide
  XENP022385 7G8_H3.35_L1.11_Fab Light Chain

SEQ ID NO: 32310 - protein, 111 aa, Artificial Sequence; identical to SEQ ID NO: 22360
  Description of Artificial Sequence: Synthetic polypeptide
  VL of XENP022385

SEQ ID NO: 32311 - protein, 15 aa, Artificial Sequence
  Description of Artificial Sequence: Synthetic peptide
  XENP022385 vlCDR1
RASQSVDYDGDSYMN

SEQ ID NO: 32312 - protein, 7 aa, Artificial Sequence
  Description of Artificial Sequence: Synthetic peptide
  XENP022385 vlCDR2
AASELES

SEQ ID NO: 32313 - protein, 9 aa, Artificial Sequence
  Description of Artificial Sequence: Synthetic peptide
  XENP022385 vlCDR3
QQSNEDPFT

SEQ ID NO: 32314 - protein, 226 aa, Artificial Sequence
  Description of Artificial Sequence: Synthetic polypeptide
  XENP022386 7G8_H3.36_L1.11_Fab Heavy Chain
EVQLVESGGGLVQPGGSLRLSCAASGFTFDDAWMDWVRQAPGKGLEWVAEISTKANNHATYYATSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32315 - protein, 121 aa, Artificial Sequence
  Description of Artificial Sequence: Synthetic polypeptide
  VH of XENP022386
EVQLVESGGGLVQPGGSLRLSCAASGFTFDDAWMDWVRQAPGKGLEWVAEISTKANNHATYYATSVKGRFTISRDDSKSSVYLQMNSLRAEDTAVYYCTRLATWDWYFDVWGQGTTVTVSS

SEQ ID NO: 32316 - protein, 5 aa, Artificial Sequence
  Description of Artificial Sequence: Synthetic peptide
  XENP022386 vhCDR1
DAWMD

SEQ ID NO: 32317 - protein, 19 aa, Artificial Sequence
  Description of Artificial Sequence: Synthetic peptide
  XENP022386 vhCDR2
EISTKANNHATYYATSVKG

SEQ ID NO: 32318 - protein, 10 aa, Artificial Sequence
  Description of Artificial Sequence: Synthetic peptide
  XENP022386 vhCDR3
LATWDWYFDV

SEQ ID NO: 32319 - protein, 218 aa, Artificial Sequence; identical to SEQ ID NO: 22359
  Description of Artificial Sequence: Synthetic polypeptide
  XENP022386 7G8_H3.36_L1.11_Fab Light Chain

SEQ ID NO: 32320 - protein, 111 aa, Artificial Sequence; identical to SEQ ID NO: 22360
  Description of Artificial Sequence: Synthetic polypeptide
  VL of XENP022386

SEQ ID NO: 32321 - protein, 15 aa, Artificial Sequence
  Description of Artificial Sequence: Synthetic peptide
  XENP022386 vlCDR1
RASQSVDYDGDSYMN

SEQ ID NO: 32322 - protein, 7 aa, Artificial Sequence
  Description of Artificial Sequence: Synthetic peptide
  XENP022386 vlCDR2
AASELES

SEQ ID NO: 32323 - protein, 9 aa, Artificial Sequence
  Description of Artificial Sequence: Synthetic peptide
  XENP022386 vlCDR3
QQSNEDPFT

SEQ ID NO: 32324 - protein, 226 aa, Artificial Sequence
  Description of Artificial Sequence: Synthetic polypeptide
  XENP022387 7G8_H3.37_L1.11_Fab Heavy Chain
EVQLVESGGGLVQPGGSLRLSCAASGFTFDDAWMDWVRQAPGKGLEWVAEISTKANNHATYYADSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32325 - protein, 121 aa, Artificial Sequence
  Description of Artificial Sequence: Synthetic polypeptide
  VH of XENP022387
EVQLVESGGGLVQPGGSLRLSCAASGFTFDDAWMDWVRQAPGKGLEWVAEISTKANNHATYYADSVKGRFTISRDDSKSSVYLQMNSLRAEDTAVYYCTRLATWDWYFDVWGQGTTVTVSS

SEQ ID NO: 32326 - protein, 5 aa, Artificial Sequence
  Description of Artificial Sequence: Synthetic peptide
  XENP022387 vhCDR1
DAWMD

SEQ ID NO: 32327 - protein, 19 aa, Artificial Sequence
  Description of Artificial Sequence: Synthetic peptide
  XENP022387 vhCDR2
EISTKANNHATYYADSVKG

SEQ ID NO: 32328 - protein, 10 aa, Artificial Sequence
  Description of Artificial Sequence: Synthetic peptide
  XENP022387 vhCDR3
LATWDWYFDV

SEQ ID NO: 32329 - protein, 218 aa, Artificial Sequence; identical to SEQ ID NO: 22359
  Description of Artificial Sequence: Synthetic polypeptide
  XENP022387 7G8_H3.37_L1.11_Fab Light Chain

SEQ ID NO: 32330 - protein, 111 aa, Artificial Sequence; identical to SEQ ID NO: 22360
  Description of Artificial Sequence: Synthetic polypeptide
  VL of XENP022387

SEQ ID NO: 32331 - protein, 15 aa, Artificial Sequence
  Description of Artificial Sequence: Synthetic peptide
  XENP022387 vlCDR1
RASQSVDYDGDSYMN

SEQ ID NO: 32332 - protein, 7 aa, Artificial Sequence
  Description of Artificial Sequence: Synthetic peptide
  XENP022387 vlCDR2
AASELES

SEQ ID NO: 32333 - protein, 9 aa, Artificial Sequence
  Description of Artificial Sequence: Synthetic peptide
  XENP022387 vlCDR3
QQSNEDPFT

SEQ ID NO: 32334 - protein, 226 aa, Artificial Sequence
  Description of Artificial Sequence: Synthetic polypeptide
  XENP022388 7G8_H3.38_L1.11_Fab Heavy Chain
EVQLVESGGGLVQPGGSLRLSCAASGFTFDDAWMDWVRQAPGKGLEWVAEISTKANNHATYYAGSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32335 - protein, 121 aa, Artificial Sequence
  Description of Artificial Sequence: Synthetic polypeptide
  VH of XENP022388
EVQLVESGGGLVQPGGSLRLSCAASGFTFDDAWMDWVRQAPGKGLEWVAEISTKANNHATYYAGSVKGRFTISRDDSKSSVYLQMNSLRAEDTAVYYCTRLATWDWYFDVWGQGTTVTVSS

SEQ ID NO: 32336 - protein, 5 aa, Artificial Sequence
  Description of Artificial Sequence: Synthetic peptide
  XENP022388 vhCDR1
DAWMD

SEQ ID NO: 32337 - protein, 19 aa, Artificial Sequence
  Description of Artificial Sequence: Synthetic peptide
  XENP022388 vhCDR2
EISTKANNHATYYAGSVKG

SEQ ID NO: 32338 - protein, 10 aa, Artificial Sequence
  Description of Artificial Sequence: Synthetic peptide
  XENP022388 vhCDR3
LATWDWYFDV

SEQ ID NO: 32339 - protein, 218 aa, Artificial Sequence; identical to SEQ ID NO: 22359
  Description of Artificial Sequence: Synthetic polypeptide
  XENP022388 7G8_H3.38_L1.11_Fab Light Chain

SEQ ID NO: 32340 - protein, 111 aa, Artificial Sequence; identical to SEQ ID NO: 22360
  Description of Artificial Sequence: Synthetic polypeptide
  VL of XENP022388

SEQ ID NO: 32341 - protein, 15 aa, Artificial Sequence
  Description of Artificial Sequence: Synthetic peptide
  XENP022388 vlCDR1
RASQSVDYDGDSYMN

SEQ ID NO: 32342 - protein, 7 aa, Artificial Sequence
  Description of Artificial Sequence: Synthetic peptide
  XENP022388 vlCDR2
AASELES

SEQ ID NO: 32343 - protein, 9 aa, Artificial Sequence
  Description of Artificial Sequence: Synthetic peptide
  XENP022388 vlCDR3
QQSNEDPFT

SEQ ID NO: 32344 - protein, 226 aa, Artificial Sequence
  Description of Artificial Sequence: Synthetic polypeptide
  XENP022389 7G8_H3.39_L1.11_Fab Heavy Chain
EVQLVESGGGLVQPGGSLRLSCAASGFTFDDAWMDWVRQAPGKGLEWVAEISTKANNHATYYAASVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32345 - protein, 121 aa, Artificial Sequence
  Description of Artificial Sequence: Synthetic polypeptide
  VH of XENP022389
EVQLVESGGGLVQPGGSLRLSCAASGFTFDDAWMDWVRQAPGKGLEWVAEISTKANNHATYYAASVKGRFTISRDDSKSSVYLQMNSLRAEDTAVYYCTRLATWDWYFDVWGQGTTVTVSS

SEQ ID NO: 32346 - protein, 5 aa, Artificial Sequence
  Description of Artificial Sequence: Synthetic peptide
  XENP022389 vhCDR1
DAWMD

SEQ ID NO: 32347 - protein, 19 aa, Artificial Sequence
  Description of Artificial Sequence: Synthetic peptide
  XENP022389 vhCDR2
EISTKANNHATYYAASVKG

SEQ ID NO: 32348 - protein, 10 aa, Artificial Sequence
  Description of Artificial Sequence: Synthetic peptide
  XENP022389 vhCDR3
LATWDWYFDV

SEQ ID NO: 32349 - protein, 218 aa, Artificial Sequence; identical to SEQ ID NO: 22359
  Description of Artificial Sequence: Synthetic polypeptide
  XENP022389 7G8_H3.39_L1.11_Fab Light Chain

SEQ ID NO: 32350 - protein, 111 aa, Artificial Sequence; identical to SEQ ID NO: 22360
  Description of Artificial Sequence: Synthetic polypeptide
  VL of XENP022389

SEQ ID NO: 32351 - protein, 15 aa, Artificial Sequence
  Description of Artificial Sequence: Synthetic peptide
  XENP022389 vlCDR1
RASQSVDYDGDSYMN

SEQ ID NO: 32352 - protein, 7 aa, Artificial Sequence
  Description of Artificial Sequence: Synthetic peptide
  XENP022389 vlCDR2
AASELES

SEQ ID NO: 32353 - protein, 9 aa, Artificial Sequence
  Description of Artificial Sequence: Synthetic peptide
  XENP022389 vlCDR3
QQSNEDPFT

SEQ ID NO: 32354 - protein, 226 aa, Artificial Sequence
  Description of Artificial Sequence: Synthetic polypeptide
  XENP022390 7G8_H3.40_L1.11_Fab Heavy Chain
EVQLVESGGGLVQPGGSLRLSCAASGFTFDDAWMDWVRQAPGKGLEWVAEISTKANNHATYYAVSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32355 - protein, 121 aa, Artificial Sequence
  Description of Artificial Sequence: Synthetic polypeptide
  VH of XENP022390
EVQLVESGGGLVQPGGSLRLSCAASGFTFDDAWMDWVRQAPGKGLEWVAEISTKANNHATYYAVSVKGRFTISRDDSKSSVYLQMNSLRAEDTAVYYCTRLATWDWYFDVWGQGTTVTVSS

SEQ ID NO: 32356 - protein, 5 aa, Artificial Sequence
  Description of Artificial Sequence: Synthetic peptide
  XENP022390 vhCDR1
DAWMD

SEQ ID NO: 32357 - protein, 19 aa, Artificial Sequence
  Description of Artificial Sequence: Synthetic peptide
  XENP022390 vhCDR2
EISTKANNHATYYAVSVKG

SEQ ID NO: 32358 - protein, 10 aa, Artificial Sequence
  Description of Artificial Sequence: Synthetic peptide
  XENP022390 vhCDR3
LATWDWYFDV

SEQ ID NO: 32359 - protein, 218 aa, Artificial Sequence; identical to SEQ ID NO: 22359
  Description of Artificial Sequence: Synthetic polypeptide
  XENP022390 7G8_H3.40_L1.11_Fab Light Chain

SEQ ID NO: 32360 - protein, 111 aa, Artificial Sequence; identical to SEQ ID NO: 22360
  Description of Artificial Sequence: Synthetic polypeptide
  VL of XENP022390

SEQ ID NO: 32361 - protein, 15 aa, Artificial Sequence
  Description of Artificial Sequence: Synthetic peptide
  XENP022390 vlCDR1
RASQSVDYDGDSYMN

SEQ ID NO: 32362 - protein, 7 aa, Artificial Sequence
  Description of Artificial Sequence: Synthetic peptide
  XENP022390 vlCDR2
AASELES

SEQ ID NO: 32363 - protein, 9 aa, Artificial Sequence
  Description of Artificial Sequence: Synthetic peptide
  XENP022390 vlCDR3
QQSNEDPFT

SEQ ID NO: 32364 - protein, 226 aa, Artificial Sequence
  Description of Artificial Sequence: Synthetic polypeptide
  XENP022391 7G8_H3.41_L1.11_Fab Heavy Chain
EVQLVESGGGLVQPGGSLRLSCAASGFTFDDAWMDWVRQAPGKGLEWVAEISTKANNHATYYAESVKGRFTISRDTSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32365 - protein, 121 aa, Artificial Sequence
  Description of Artificial Sequence: Synthetic polypeptide
  VH of XENP022391
EVQLVESGGGLVQPGGSLRLSCAASGFTFDDAWMDWVRQAPGKGLEWVAEISTKANNHATYYAESVKGRFTISRDTSKSSVYLQMNSLRAEDTAVYYCTRLATWDWYFDVWGQGTTVTVSS

SEQ ID NO: 32366 - protein, 5 aa, Artificial Sequence
  Description of Artificial Sequence: Synthetic peptide
  XENP022391 vhCDR1
DAWMD

SEQ ID NO: 32367 - protein, 19 aa, Artificial Sequence
  Description of Artificial Sequence: Synthetic peptide
  XENP022391 vhCDR2
EISTKANNHATYYAESVKG

SEQ ID NO: 32368 - protein, 10 aa, Artificial Sequence
  Description of Artificial Sequence: Synthetic peptide
  XENP022391 vhCDR3
LATWDWYFDV

SEQ ID NO: 32369 - protein, 218 aa, Artificial Sequence; identical to SEQ ID NO: 22359
  Description of Artificial Sequence: Synthetic polypeptide
  XENP022391 7G8_H3.41_L1.11_Fab Light Chain

SEQ ID NO: 32370 - protein, 111 aa, Artificial Sequence; identical to SEQ ID NO: 22360
  Description of Artificial Sequence: Synthetic polypeptide
  VL of XENP022391

SEQ ID NO: 32371 - protein, 15 aa, Artificial Sequence
  Description of Artificial Sequence: Synthetic peptide
  XENP022391 vlCDR1
RASQSVDYDGDSYMN

SEQ ID NO: 32372 - protein, 7 aa, Artificial Sequence
  Description of Artificial Sequence: Synthetic peptide
  XENP022391 vlCDR2
AASELES

SEQ ID NO: 32373 - protein, 9 aa, Artificial Sequence
  Description of Artificial Sequence: Synthetic peptide
  XENP022391 vlCDR3
QQSNEDPFT

SEQ ID NO: 32374 - protein, 226 aa, Artificial Sequence
  Description of Artificial Sequence: Synthetic polypeptide
  XENP022392 7G8_H3.42_L1.11_Fab Heavy Chain
EVQLVESGGGLVQPGGSLRLSCAASGFTFDDAWMDWVRQAPGKGLEWVAEISTKANNHATYYAESVKGRFTISRDRSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32375 - protein, 121 aa, Artificial Sequence
  Description of Artificial Sequence: Synthetic polypeptide
  VH of XENP022392
EVQLVESGGGLVQPGGSLRLSCAASGFTFDDAWMDWVRQAPGKGLEWVAEISTKANNHATYYAESVKGRFTISRDRSKSSVYLQMNSLRAEDTAVYYCTRLATWDWYFDVWGQGTTVTVSS

SEQ ID NO: 32376 - protein, 5 aa, Artificial Sequence
  Description of Artificial Sequence: Synthetic peptide
  XENP022392 vhCDR1
DAWMD

SEQ ID NO: 32377 - protein, 19 aa, Artificial Sequence
  Description of Artificial Sequence: Synthetic peptide
  XENP022392 vhCDR2
EISTKANNHATYYAESVKG

SEQ ID NO: 32378 - protein, 10 aa, Artificial Sequence
  Description of Artificial Sequence: Synthetic peptide
  XENP022392 vhCDR3
LATWDWYFDV

SEQ ID NO: 32379 - protein, 218 aa, Artificial Sequence; identical to SEQ ID NO: 22359
  Description of Artificial Sequence: Synthetic polypeptide
  XENP022392 7G8_H3.42_L1.11_Fab Light Chain

SEQ ID NO: 32380 - protein, 111 aa, Artificial Sequence; identical to SEQ ID NO: 22360
  Description of Artificial Sequence: Synthetic polypeptide
  VL of XENP022392

SEQ ID NO: 32381 - protein, 15 aa, Artificial Sequence
  Description of Artificial Sequence: Synthetic peptide
  XENP022392 vlCDR1
RASQSVDYDGDSYMN

SEQ ID NO: 32382 - protein, 7 aa, Artificial Sequence
  Description of Artificial Sequence: Synthetic peptide
  XENP022392 vlCDR2
AASELES

SEQ ID NO: 32383 - protein, 9 aa, Artificial Sequence
  Description of Artificial Sequence: Synthetic peptide
  XENP022392 vlCDR3
QQSNEDPFT

SEQ ID NO: 32384 - protein, 226 aa, Artificial Sequence
  Description of Artificial Sequence: Synthetic polypeptide
  XENP022393 7G8_H3.43_L1.11_Fab Heavy Chain
EVQLVESGGGLVQPGGSLRLSCAASGFTFDDAWMDWVRQAPGKGLEWVAEISTKANNHATYYAESVKGRFTISRDMSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32385 - protein, 121 aa, Artificial Sequence
  Description of Artificial Sequence: Synthetic polypeptide
  VH of XENP022393
EVQLVESGGGLVQPGGSLRLSCAASGFTFDDAWMDWVRQAPGKGLEWVAEISTKANNHATYYAESVKGRFTISRDMSKSSVYLQMNSLRAEDTAVYYCTRLATWDWYFDVWGQGTTVTVSS

SEQ ID NO: 32386 - protein, 5 aa, Artificial Sequence
  Description of Artificial Sequence: Synthetic peptide
  XENP022393 vhCDR1
DAWMD

SEQ ID NO: 32387 - protein, 19 aa, Artificial Sequence
  Description of Artificial Sequence: Synthetic peptide
  XENP022393 vhCDR2
EISTKANNHATYYAESVKG

SEQ ID NO: 32388 - protein, 10 aa, Artificial Sequence
  Description of Artificial Sequence: Synthetic peptide
  XENP022393 vhCDR3
LATWDWYFDV

SEQ ID NO: 32389 - protein, 218 aa, Artificial Sequence; identical to SEQ ID NO: 22359
  Description of Artificial Sequence: Synthetic polypeptide
  XENP022393 7G8_H3.43_L1.11_Fab Light Chain

SEQ ID NO: 32390 - protein, 111 aa, Artificial Sequence; identical to SEQ ID NO: 22360
  Description of Artificial Sequence: Synthetic polypeptide
  VL of XENP022393

SEQ ID NO: 32391 - protein, 15 aa, Artificial Sequence
  Description of Artificial Sequence: Synthetic peptide
  XENP022393 vlCDR1
RASQSVDYDGDSYMN

SEQ ID NO: 32392 - protein, 7 aa, Artificial Sequence
  Description of Artificial Sequence: Synthetic peptide
  XENP022393 vlCDR2
AASELES

SEQ ID NO: 32393 - protein, 9 aa, Artificial Sequence
  Description of Artificial Sequence: Synthetic peptide
  XENP022393 vlCDR3
QQSNEDPFT

SEQ ID NO: 32394 - protein, 226 aa, Artificial Sequence
  Description of Artificial Sequence: Synthetic polypeptide
  XENP022394 7G8_H3.44_L1.11_Fab Heavy Chain
EVQLVESGGGLVQPGGSLRLSCAASGFTFDDAWMDWVRQAPGKGLEWVAEISTKANNHATYYAESVKGRFTISRDESKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32395 - protein, 121 aa, Artificial Sequence
  Description of Artificial Sequence: Synthetic polypeptide
  VH of XENP022394
EVQLVESGGGLVQPGGSLRLSCAASGFTFDDAWMDWVRQAPGKGLEWVAEISTKANNHATYYAESVKGRFTISRDESKSSVYLQMNSLRAEDTAVYYCTRLATWDWYFDVWGQGTTVTVSS

SEQ ID NO: 32396 - protein, 5 aa, Artificial Sequence
  Description of Artificial Sequence: Synthetic peptide
  XENP022394 vhCDR1
DAWMD

SEQ ID NO: 32397 - protein, 19 aa, Artificial Sequence
  Description of Artificial Sequence: Synthetic peptide
  XENP022394 vhCDR2
EISTKANNHATYYAESVKG

SEQ ID NO: 32398 - protein, 10 aa, Artificial Sequence
  Description of Artificial Sequence: Synthetic peptide
  XENP022394 vhCDR3
LATWDWYFDV

SEQ ID NO: 32399 - protein, 218 aa, Artificial Sequence; identical to SEQ ID NO: 22359
  Description of Artificial Sequence: Synthetic polypeptide
  XENP022394 7G8_H3.44_L1.11_Fab Light Chain

SEQ ID NO: 32400 - protein, 111 aa, Artificial Sequence; identical to SEQ ID NO: 22360
  Description of Artificial Sequence: Synthetic polypeptide
  VL of XENP022394

SEQ ID NO: 32401 - protein, 15 aa, Artificial Sequence
  Description of Artificial Sequence: Synthetic peptide
  XENP022394 vlCDR1
RASQSVDYDGDSYMN

SEQ ID NO: 32402 - protein, 7 aa, Artificial Sequence
  Description of Artificial Sequence: Synthetic peptide
  XENP022394 vlCDR2
AASELES

SEQ ID NO: 32403 - protein, 9 aa, Artificial Sequence
  Description of Artificial Sequence: Synthetic peptide
  XENP022394 vlCDR3
QQSNEDPFT

SEQ ID NO: 32404 - protein, 226 aa, Artificial Sequence
  Description of Artificial Sequence: Synthetic polypeptide
  XENP022395 7G8_H3.45_L1.11_Fab Heavy Chain
EVQLVESGGGLVQPGGSLRLSCAASGFTFDDAWMDWVRQAPGKGLEWVAEISTKANNHATYYAESVKGRFTISRDNSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32405 - protein, 121 aa, Artificial Sequence
  Description of Artificial Sequence: Synthetic polypeptide
  VH of XENP022395
EVQLVESGGGLVQPGGSLRLSCAASGFTFDDAWMDWVRQAPGKGLEWVAEISTKANNHATYYAESVKGRFTISRDNSKSSVYLQMNSLRAEDTAVYYCTRLATWDWYFDVWGQGTTVTVSS

SEQ ID NO: 32406 - protein, 5 aa, Artificial Sequence
  Description of Artificial Sequence: Synthetic peptide
  XENP022395 vhCDR1
DAWMD

SEQ ID NO: 32407 - protein, 19 aa, Artificial Sequence
  Description of Artificial Sequence: Synthetic peptide
  XENP022395 vhCDR2
EISTKANNHATYYAESVKG

SEQ ID NO: 32408 - protein, 10 aa, Artificial Sequence
  Description of Artificial Sequence: Synthetic peptide
  XENP022395 vhCDR3
LATWDWYFDV

SEQ ID NO: 32409 - protein, 218 aa, Artificial Sequence; identical to SEQ ID NO: 22359
  Description of Artificial Sequence: Synthetic polypeptide
  XENP022395 7G8_H3.45_L1.11_Fab Light Chain

SEQ ID NO: 32410 - protein, 111 aa, Artificial Sequence; identical to SEQ ID NO: 22360
  Description of Artificial Sequence: Synthetic polypeptide
  VL of XENP022395

SEQ ID NO: 32411 - protein, 15 aa, Artificial Sequence
  Description of Artificial Sequence: Synthetic peptide
  XENP022395 vlCDR1
RASQSVDYDGDSYMN

SEQ ID NO: 32412 - protein, 7 aa, Artificial Sequence
  Description of Artificial Sequence: Synthetic peptide
  XENP022395 vlCDR2
AASELES

SEQ ID NO: 32413 - protein, 9 aa, Artificial Sequence
  Description of Artificial Sequence: Synthetic peptide
  XENP022395 vlCDR3
QQSNEDPFT

SEQ ID NO: 32414 - protein, 226 aa, Artificial Sequence
  Description of Artificial Sequence: Synthetic polypeptide
  XENP022396 7G8_H3.46_L1.11_Fab Heavy Chain
EVQLVESGGGLVQPGGSLRLSCAASGFTFDDAWMDWVRQAPGKGLEWVAEISTKANNHATYYAESVKGRFTISRDKSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32415 - protein, 121 aa, Artificial Sequence
  Description of Artificial Sequence: Synthetic polypeptide
  VH of XENP022396
EVQLVESGGGLVQPGGSLRLSCAASGFTFDDAWMDWVRQAPGKGLEWVAEISTKANNHATYYAESVKGRFTISRDKSKSSVYLQMNSLRAEDTAVYYCTRLATWDWYFDVWGQGTTVTVSS

SEQ ID NO: 32416 - protein, 5 aa, Artificial Sequence
  Description of Artificial Sequence: Synthetic peptide
  XENP022396 vhCDR1
DAWMD

SEQ ID NO: 32417 - protein, 19 aa, Artificial Sequence
  Description of Artificial Sequence: Synthetic peptide
  XENP022396 vhCDR2
EISTKANNHATYYAESVKG

SEQ ID NO: 32418 - protein, 10 aa, Artificial Sequence
  Description of Artificial Sequence: Synthetic peptide
  XENP022396 vhCDR3
LATWDWYFDV

SEQ ID NO: 32419 - protein, 218 aa, Artificial Sequence; identical to SEQ ID NO: 22359
  Description of Artificial Sequence: Synthetic polypeptide
  XENP022396 7G8_H3.46_L1.11_Fab Light Chain

SEQ ID NO: 32420 - protein, 111 aa, Artificial Sequence; identical to SEQ ID NO: 22360
  Description of Artificial Sequence: Synthetic polypeptide
  VL of XENP022396

SEQ ID NO: 32421 - protein, 15 aa, Artificial Sequence
  Description of Artificial Sequence: Synthetic peptide
  XENP022396 vlCDR1
RASQSVDYDGDSYMN

SEQ ID NO: 32422 - protein, 7 aa, Artificial Sequence
  Description of Artificial Sequence: Synthetic peptide
  XENP022396 vlCDR2
AASELES

SEQ ID NO: 32423 - protein, 9 aa, Artificial Sequence
  Description of Artificial Sequence: Synthetic peptide
  XENP022396 vlCDR3
QQSNEDPFT

SEQ ID NO: 32424 - protein, 226 aa, Artificial Sequence
  Description of Artificial Sequence: Synthetic polypeptide
  XENP022401 7G8_H3.47_L1.11_Fab Heavy Chain
EVQLVESGGGLVQPGGSLRLSCAASGFTFDDAWMDWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32425 - protein, 121 aa, Artificial Sequence
  Description of Artificial Sequence: Synthetic polypeptide
  VH of XENP022401
EVQLVESGGGLVQPGGSLRLSCAASGFTFDDAWMDWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32426 - protein, 5 aa, Artificial Sequence
  Description of Artificial Sequence: Synthetic peptide
  XENP022401 vhCDR1
DAWMD

SEQ ID NO: 32427 - protein, 19 aa, Artificial Sequence
  Description of Artificial Sequence: Synthetic peptide
  XENP022401 vhCDR2
EISTKANNHATYYAESVKG

SEQ ID NO: 32428 - protein, 10 aa, Artificial Sequence
  Description of Artificial Sequence: Synthetic peptide
  XENP022401 vhCDR3
LATWDWYFDV

SEQ ID NO: 32429 - protein, 218 aa, Artificial Sequence; identical to SEQ ID NO: 22359
  Description of Artificial Sequence: Synthetic polypeptide
  XENP022401 7G8_H3.47_L1.11_Fab Light Chain

SEQ ID NO: 32430 - protein, 111 aa, Artificial Sequence; identical to SEQ ID NO: 22360
  Description of Artificial Sequence: Synthetic polypeptide
  VL of XENP022401

SEQ ID NO: 32431 - protein, 15 aa, Artificial Sequence
  Description of Artificial Sequence: Synthetic peptide
  XENP022401 vlCDR1
RASQSVDYDGDSYMN

SEQ ID NO: 32432 - protein, 7 aa, Artificial Sequence
  Description of Artificial Sequence: Synthetic peptide
  XENP022401 vlCDR2
AASELES

SEQ ID NO: 32433 - protein, 9 aa, Artificial Sequence
  Description of Artificial Sequence: Synthetic peptide
  XENP022401 vlCDR3
QQSNEDPFT

SEQ ID NO: 32434 - protein, 226 aa, Artificial Sequence
  Description of Artificial Sequence: Synthetic polypeptide
  XENP022402 7G8_H3.48_L1.11_Fab Heavy Chain
EVQLVESGGGLVQPGGSLRLSCAASGFTFDDAWMDWVRQAPGKGLEWVAEISTKANNHATYYAESVKGRFTISRDDSKSQVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32435 - protein, 121 aa, Artificial Sequence
  Description of Artificial Sequence: Synthetic polypeptide
  VH of XENP022402
EVQLVESGGGLVQPGGSLRLSCAASGFTFDDAWMDWVRQAPGKGLEWVAEISTKANNHATYYAESVKGRFTISRDDSKSQVYLQMNSLRAEDTAVYYCTRLATWDWYFDVWGQGTTVTVSS

SEQ ID NO: 32436 - protein, 5 aa, Artificial Sequence
  Description of Artificial Sequence: Synthetic peptide
  XENP022402 vhCDR1
DAWMD

SEQ ID NO: 32437 - protein, 19 aa, Artificial Sequence
  Description of Artificial Sequence: Synthetic peptide
  XENP022402 vhCDR2
EISTKANNHATYYAESVKG

SEQ ID NO: 32438 - protein, 10 aa, Artificial Sequence
  Description of Artificial Sequence: Synthetic peptide
  XENP022402 vhCDR3
LATWDWYFDV

SEQ ID NO: 32439 - protein, 218 aa, Artificial Sequence; identical to SEQ ID NO: 22359
  Description of Artificial Sequence: Synthetic polypeptide
  XENP022402 7G8_H3.48_L1.11_Fab Light Chain

SEQ ID NO: 32440 - protein, 111 aa, Artificial Sequence; identical to SEQ ID NO: 22360
  Description of Artificial Sequence: Synthetic polypeptide
  VL of XENP022402

SEQ ID NO: 32441 - protein, 15 aa, Artificial Sequence
  Description of Artificial Sequence: Synthetic peptide
  XENP022402 vlCDR1
RASQSVDYDGDSYMN

SEQ ID NO: 32442 - protein, 7 aa, Artificial Sequence
  Description of Artificial Sequence: Synthetic peptide
  XENP022402 vlCDR2
AASELES

SEQ ID NO: 32443 - protein, 9 aa, Artificial Sequence
  Description of Artificial Sequence: Synthetic peptide
  XENP022402 vlCDR3
QQSNEDPFT

SEQ ID NO: 32444 - protein, 226 aa, Artificial Sequence
  Description of Artificial Sequence: Synthetic polypeptide
  XENP022403 7G8_H3.49_L1.11_Fab Heavy Chain
EVQLVESGGGLVQPGGSLRLSCAASGFTFDDAWMDWVRQAPGKGLEWVAEISTKANNHATYYAESVKGRFTISRDDSKSIVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32445 - protein, 121 aa, Artificial Sequence
  Description of Artificial Sequence: Synthetic polypeptide
  VH of XENP022403
EVQLVESGGGLVQPGGSLRLSCAASGFTFDDAWMDWVRQAPGKGLEWVAEISTKANNHATYYAESVKGRFTISRDDSKSIVYLQMNSLRAEDTAVYYCTRLATWDWYFDVWGQGTTVTVSS

SEQ ID NO: 32446 - protein, 5 aa, Artificial Sequence
  Description of Artificial Sequence: Synthetic peptide
  XENP022403 vhCDR1
DAWMD

SEQ ID NO: 32447 - protein, 19 aa, Artificial Sequence
  Description of Artificial Sequence: Synthetic peptide
  XENP022403 vhCDR2
EISTKANNHATYYAESVKG

SEQ ID NO: 32448 - protein, 10 aa, Artificial Sequence
  Description of Artificial Sequence: Synthetic peptide
  XENP022403 vhCDR3
LATWDWYFDV

SEQ ID NO: 32449 - protein, 218 aa, Artificial Sequence; identical to SEQ ID NO: 22359
  Description of Artificial Sequence: Synthetic polypeptide
  XENP022403 7G8_H3.49_L1.11_Fab Light Chain

SEQ ID NO: 32450 - protein, 111 aa, Artificial Sequence; identical to SEQ ID NO: 22360
  Description of Artificial Sequence: Synthetic polypeptide
  VL of XENP022403

SEQ ID NO: 32451 - protein, 15 aa, Artificial Sequence
  Description of Artificial Sequence: Synthetic peptide
  XENP022403 vlCDR1
RASQSVDYDGDSYMN

SEQ ID NO: 32452 - protein, 7 aa, Artificial Sequence
  Description of Artificial Sequence: Synthetic peptide
  XENP022403 vlCDR2
AASELES

SEQ ID NO: 32453 - protein, 9 aa, Artificial Sequence
  Description of Artificial Sequence: Synthetic peptide
  XENP022403 vlCDR3
QQSNEDPFT

SEQ ID NO: 32454 - protein, 226 aa, Artificial Sequence
  Description of Artificial Sequence: Synthetic polypeptide
  XENP022404 7G8_H3.50_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSAYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32455 - protein, 121 aa, Artificial Sequence
  Description of Artificial Sequence: Synthetic polypeptide
  VH of XENP022404
EVQLVESGGGLVQPGGSLRLSCAASGFTFDDAWMDWVRQAPGKGLEWVAEISTKANNHATYYAESVKGRFTISRDDSKSSAYLQMNSLRAEDTAVYYCTRLATWDWYFDVWGQGTTVTVSS

SEQ ID NO: 32456 - protein, 5 aa, Artificial Sequence
  Description of Artificial Sequence: Synthetic peptide
  XENP022404 vhCDR1
DAWMD

SEQ ID NO: 32457 - protein, 19 aa, Artificial Sequence
  Description of Artificial Sequence: Synthetic peptide
  XENP022404 vhCDR2
EISTKANNHATYYAESVKG

SEQ ID NO: 32458 - protein, 10 aa, Artificial Sequence
  Description of Artificial Sequence: Synthetic peptide
  XENP022404 vhCDR3
LATWDWYFDV

SEQ ID NO: 32459 - protein, 218 aa, Artificial Sequence; identical to SEQ ID NO: 22359
  Description of Artificial Sequence: Synthetic polypeptide
  XENP022404 7G8_H3.50_L1.11_Fab Light Chain

SEQ ID NO: 32460 - protein, 111 aa, Artificial Sequence; identical to SEQ ID NO: 22360
  Description of Artificial Sequence: Synthetic polypeptide
  VL of XENP022404

SEQ ID NO: 32461 - protein, 15 aa, Artificial Sequence
  Description of Artificial Sequence: Synthetic peptide
  XENP022404 vlCDR1
RASQSVDYDGDSYMN

SEQ ID NO: 32462 - protein, 7 aa, Artificial Sequence
  Description of Artificial Sequence: Synthetic peptide
  XENP022404 vlCDR2
AASELES

SEQ ID NO: 32463 - protein, 9 aa, Artificial Sequence
  Description of Artificial Sequence: Synthetic peptide
  XENP022404 vlCDR3
QQSNEDPFT

SEQ ID NO: 32464 - protein, 226 aa, Artificial Sequence
  Description of Artificial Sequence: Synthetic polypeptide
  XENP022405 7G8_H3.51_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSLYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32465 - protein, 121 aa, Artificial Sequence
  Description of Artificial Sequence: Synthetic polypeptide
  VH of XENP022405
EVQLVESGGGLVQPGGSLRLSCAASGFTFDDAWMDWVRQAPGKGLEWVAEISTKANNHATYYAESVKGRFTISRDDSKSSLYLQMNSLRAEDTAVYYCTRLATWDWYFDVWGQGTTVTVSS

SEQ ID NO: 32466 - protein, 5 aa, Artificial Sequence
  Description of Artificial Sequence: Synthetic peptide
  XENP022405 vhCDR1
DAWMD

SEQ ID NO: 32467 - protein, 19 aa, Artificial Sequence
  Description of Artificial Sequence: Synthetic peptide
  XENP022405 vhCDR2
EISTKANNHATYYAESVKG

SEQ ID NO: 32468 - protein, 10 aa, Artificial Sequence
  Description of Artificial Sequence: Synthetic peptide
  XENP022405 vhCDR3
LATWDWYFDV

SEQ ID NO: 32469 - protein, 218 aa, Artificial Sequence; identical to SEQ ID NO: 22359
  Description of Artificial Sequence: Synthetic polypeptide
  XENP022405 7G8_H3.51_L1.11_Fab Light Chain

SEQ ID NO: 32470 - protein, 111 aa, Artificial Sequence; identical to SEQ ID NO: 22360
  Description of Artificial Sequence: Synthetic polypeptide
  VL of XENP022405

SEQ ID NO: 32471 - protein, 15 aa, Artificial Sequence
  Description of Artificial Sequence: Synthetic peptide
  XENP022405 vlCDR1
RASQSVDYDGDSYMN

SEQ ID NO: 32472 - protein, 7 aa, Artificial Sequence
  Description of Artificial Sequence: Synthetic peptide
  XENP022405 vlCDR2
AASELES

SEQ ID NO: 32473 - protein, 9 aa, Artificial Sequence
  Description of Artificial Sequence: Synthetic peptide
  XENP022405 vlCDR3
QQSNEDPFT

SEQ ID NO: 32474 - protein, 226 aa, Artificial Sequence
  Description of Artificial Sequence: Synthetic polypeptide
  XENP022406 7G8_H3.52_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSFYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32475 - protein, 121 aa, Artificial Sequence
  Description of Artificial Sequence: Synthetic polypeptide
  VH of XENP022406
EVQLVESGGGLVQPGGSLRLSCAASGFTFDDAWMDWVRQAPGKGLEWVAEISTKANNHATYYAESVKGRFTISRDDSKSSFYLQMNSLRAEDTAVYYCTRLATWDWYFDVWGQGTTVTVSS

SEQ ID NO: 32476 - protein, 5 aa, Artificial Sequence
  Description of Artificial Sequence: Synthetic peptide
  XENP022406 vhCDR1
DAWMD

SEQ ID NO: 32477 - protein, 19 aa, Artificial Sequence
  Description of Artificial Sequence: Synthetic peptide
  XENP022406 vhCDR2
EISTKANNHATYYAESVKG

SEQ ID NO: 32478 - protein, 10 aa, Artificial Sequence
  Description of Artificial Sequence: Synthetic peptide
  XENP022406 vhCDR3
LATWDWYFDV

SEQ ID NO: 32479 - protein, 218 aa, Artificial Sequence; identical to SEQ ID NO: 22359
  Description of Artificial Sequence: Synthetic polypeptide
  XENP022406 7G8_H3.52_L1.11_Fab Light Chain

SEQ ID NO: 32480 - protein, 111 aa, Artificial Sequence; identical to SEQ ID NO: 22360
  Description of Artificial Sequence: Synthetic polypeptide
  VL of XENP022406

SEQ ID NO: 32481 - protein, 15 aa, Artificial Sequence
  Description of Artificial Sequence: Synthetic peptide
  XENP022406 vlCDR1
RASQSVDYDGDSYMN

SEQ ID NO: 32482 - protein, 7 aa, Artificial Sequence
  Description of Artificial Sequence: Synthetic peptide
  XENP022406 vlCDR2
AASELES

SEQ ID NO: 32483 - protein, 9 aa, Artificial Sequence
  Description of Artificial Sequence: Synthetic peptide
  XENP022406 vlCDR3
QQSNEDPFT

SEQ ID NO: 32484 - protein, 226 aa, Artificial Sequence
  Description of Artificial Sequence: Synthetic polypeptide
  XENP022407 7G8_H3.53_L1.11_Fab Heavy Chain
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCARLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32485 - protein, 121 aa, Artificial Sequence
  Description of Artificial Sequence: Synthetic polypeptide
  VH of XENP022407
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCARLATWDWYFDVWGQGTTVTVSS

SEQ ID NO: 32486 - protein, 5 aa, Artificial Sequence
  Description of Artificial Sequence: Synthetic peptide
  XENP022407 vhCDR1
DAWMD

SEQ ID NO: 32487 - protein, 19 aa, Artificial Sequence
  Description of Artificial Sequence: Synthetic peptide
  XENP022407 vhCDR2
EISTKANNHATYYAESVKG

SEQ ID NO: 32488 - protein, 10 aa, Artificial Sequence
  Description of Artificial Sequence: Synthetic peptide
  XENP022407 vhCDR3
LATWDWYFDV

SEQ ID NO: 32489 - protein, 218 aa, Artificial Sequence; identical to SEQ ID NO: 22359
  Description of Artificial Sequence: Synthetic polypeptide
  XENP022407 7G8_H3.53_L1.11_Fab Light Chain

SEQ ID NO: 32490 - protein, 111 aa, Artificial Sequence; identical to SEQ ID NO: 22360
  Description of Artificial Sequence: Synthetic polypeptide
  VL of XENP022407

SEQ ID NO: 32491 - protein, 15 aa, Artificial Sequence
  Description of Artificial Sequence: Synthetic peptide
  XENP022407 vlCDR1
RASQSVDYDGDSYMN

SEQ ID NO: 32492 - protein, 7 aa, Artificial Sequence
  Description of Artificial Sequence: Synthetic peptide
  XENP022407 vlCDR2
AASELES

SEQ ID NO: 32493 - protein, 9 aa, Artificial Sequence
  Description of Artificial Sequence: Synthetic peptide
  XENP022407 vlCDR3
QQSNEDPFT

SEQ ID NO: 32494 - protein, 226 aa, Artificial Sequence; identical to SEQ ID NO: 31734
  Description of Artificial Sequence: Synthetic polypeptide
  XENP022408 7G8_H3.18_L1.16_Fab Heavy Chain

SEQ ID NO: 32495 - protein, 121 aa, Artificial Sequence; identical to SEQ ID NO: 22325
  Description of Artificial Sequence: Synthetic polypeptide
  VH of XENP022408

SEQ ID NO: 32496 - protein, 5 aa, Artificial Sequence
  Description of Artificial Sequence: Synthetic peptide
  XENP022408 vhCDR1
DAWMD

SEQ ID NO: 32497 - protein, 19 aa, Artificial Sequence
  Description of Artificial Sequence: Synthetic peptide
  XENP022408 vhCDR2
EISTKANNHATYYAESVKG

SEQ ID NO: 32498 - protein, 10 aa, Artificial Sequence
  Description of Artificial Sequence: Synthetic peptide
  XENP022408 vhCDR3
LATWDWYFDV

SEQ ID NO: 32499 - protein, 218 aa, Artificial Sequence
  Description of Artificial Sequence: Synthetic polypeptide
  XENP022408 7G8_H3.18_L1.16_Fab Light Chain
DIVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32500 - protein, 111 aa, Artificial Sequence
  Description of Artificial Sequence: Synthetic polypeptide
  VL of XENP022408
DIVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32501 - protein, 15 aa, Artificial Sequence
  Description of Artificial Sequence: Synthetic peptide
  XENP022408 vlCDR1
RASQSVDYDGDSYMN

SEQ ID NO: 32502 - protein, 7 aa, Artificial Sequence
  Description of Artificial Sequence: Synthetic peptide
  XENP022408 vlCDR2
AASELES

SEQ ID NO: 32503 - protein, 9 aa, Artificial Sequence
  Description of Artificial Sequence: Synthetic peptide
  XENP022408 vlCDR3
QQSNEDPFT

SEQ ID NO: 32504 - protein, 226 aa, Artificial Sequence; identical to SEQ ID NO: 31734
  Description of Artificial Sequence: Synthetic polypeptide
  XENP022409 7G8_H3.18_L1.17_Fab Heavy Chain

SEQ ID NO: 32505 - protein, 121 aa, Artificial Sequence; identical to SEQ ID NO: 22325
  Description of Artificial Sequence: Synthetic polypeptide
  VH of XENP022409

SEQ ID NO: 32506 - protein, 5 aa, Artificial Sequence
  Description of Artificial Sequence: Synthetic peptide
  XENP022409 vhCDR1
DAWMD

SEQ ID NO: 32507 - protein, 19 aa, Artificial Sequence
  Description of Artificial Sequence: Synthetic peptide
  XENP022409 vhCDR2
EISTKANNHATYYAESVKG

SEQ ID NO: 32508 - protein, 10 aa, Artificial Sequence
  Description of Artificial Sequence: Synthetic peptide
  XENP022409 vhCDR3
LATWDWYFDV

SEQ ID NO: 32509 - protein, 218 aa, Artificial Sequence
  Description of Artificial Sequence: Synthetic polypeptide
  XENP022409 7G8_H3.18_L1.17_Fab Light Chain
DVVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32510 - protein, 111 aa, Artificial Sequence
  Description of Artificial Sequence: Synthetic polypeptide
  VL of XENP022409
DVVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32511 - protein, 15 aa, Artificial Sequence
  Description of Artificial Sequence: Synthetic peptide
  XENP022409 vlCDR1
RASQSVDYDGDSYMN

SEQ ID NO: 32512 - protein, 7 aa, Artificial Sequence
  Description of Artificial Sequence: Synthetic peptide
  XENP022409 vlCDR2
AASELES

SEQ ID NO: 32513 - protein, 9 aa, Artificial Sequence
  Description of Artificial Sequence: Synthetic peptide
  XENP022409 vlCDR3
QQSNEDPFT

SEQ ID NO: 32514 - protein, 226 aa, Artificial Sequence; identical to SEQ ID NO: 31734
  Description of Artificial Sequence: Synthetic polypeptide
  XENP022410 7G8_H3.18_L1.18_Fab Heavy Chain

SEQ ID NO: 32515 - protein, 121 aa, Artificial Sequence; identical to SEQ ID NO: 22325
  Description of Artificial Sequence: Synthetic polypeptide
  VH of XENP022410

SEQ ID NO: 32516 - protein, 5 aa, Artificial Sequence
  Description of Artificial Sequence: Synthetic peptide
  XENP022410 vhCDR1
DAWMD

SEQ ID NO: 32517 - protein, 19 aa, Artificial Sequence
  Description of Artificial Sequence: Synthetic peptide
  XENP022410 vhCDR2
EISTKANNHATYYAESVKG

SEQ ID NO: 32518 - protein, 10 aa, Artificial Sequence
  Description of Artificial Sequence: Synthetic peptide
  XENP022410 vhCDR3
LATWDWYFDV

SEQ ID NO: 32519 - protein, 218 aa, Artificial Sequence
  Description of Artificial Sequence: Synthetic polypeptide
  XENP022410 7G8_H3.18_L1.18_Fab Light Chain
DTVMTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32520 - protein, 111 aa, Artificial Sequence
  Description of Artificial Sequence: Synthetic polypeptide
  VL of XENP022410
DTVMTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 32521 - protein, 15 aa, Artificial Sequence
  Description of Artificial Sequence: Synthetic peptide
  XENP022410 vlCDR1
RASQSVDYDGDSYMN

SEQ ID NO: 32522 - protein, 7 aa, Artificial Sequence
  Description of Artificial Sequence: Synthetic peptide
  XENP022410 vlCDR2
AASELES

SEQ ID NO: 32523 - protein, 9 aa, Artificial Sequence
  Description of Artificial Sequence: Synthetic peptide
  XENP022410 vlCDR3
QQSNEDPFT

SEQ ID NO: 32524 - protein, 226 aa, Artificial Sequence; identical to SEQ ID NO: 31734
  Description of Artificial Sequence: Synthetic polypeptide
  XENP022411 7G8_H3.18_L1.19_Fab Heavy Chain

SEQ ID NO: 32525 - protein, 121 aa, Artificial Sequence; identical to SEQ ID NO: 22325
  Description of Artificial Sequence: Synthetic polypeptide
  VH of XENP022411

SEQ ID NO: 32526 - protein, 5 aa, Artificial Sequence
  Description of Artificial Sequence: Synthetic peptide
  XENP022411 vhCDR1
DAWMD

SEQ ID NO: 32527 - protein, 19 aa, Artificial Sequence
  Description of Artificial Sequence: Synthetic peptide
  XENP022411 vhCDR2
EISTKANNHATYYAESVKG

SEQ ID NO: 32528 - protein, 10 aa, Artificial Sequence
  Description of Artificial Sequence: Synthetic peptide
  XENP022411 vhCDR3
LATWDWYFDV

SEQ ID NO: 32529 - protein, 218 aa, Artificial Sequence
  Description of Artificial Sequence: Synthetic polypeptide
  XENP022411 7G8_H3.18_L1.19_Fab Light Chain
DTVLTQSPSSLSASVGDRVTITCRASQSVDYDGDSYLNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32530 - protein, 111 aa, Artificial Sequence
  Description of Artificial Sequence: Synthetic polypeptide
  VL of XENP022411
DTVLTQSPSSLSASVGDRVTITCRASQSVDYDGDSYLNWYQQKPGKPPKLLIYAASELESGIPARLSGSGSGTDFTLTISSLQPEDFATYYCQQSNEDPFTFGSGTKLEIK

SEQ ID NO: 32531 - protein, 15 aa, Artificial Sequence
  Description of Artificial Sequence: Synthetic peptide
  XENP022411 vlCDR1
RASQSVDYDGDSYLN

SEQ ID NO: 32532 - protein, 7 aa, Artificial Sequence
  Description of Artificial Sequence: Synthetic peptide
  XENP022411 vlCDR2
AASELES

SEQ ID NO: 32533 - protein, 9 aa, Artificial Sequence
  Description of Artificial Sequence: Synthetic peptide
  XENP022411 vlCDR3
QQSNEDPFT

SEQ ID NO: 32534 - protein, 226 aa, Artificial Sequence; identical to SEQ ID NO: 31734
  Description of Artificial Sequence: Synthetic polypeptide
  XENP022412 7G8_H3.18_L1.20_Fab Heavy Chain

SEQ ID NO: 32535 - protein, 121 aa, Artificial Sequence; identical to SEQ ID NO: 22325
  Description of Artificial Sequence: Synthetic polypeptide
  VH of XENP022412

SEQ ID NO: 32536 - protein, 5 aa, Artificial Sequence
  Description of Artificial Sequence: Synthetic peptide
  XENP022412 vhCDR1
DAWMD

SEQ ID NO: 32537 - protein, 19 aa, Artificial Sequence
  Description of Artificial Sequence: Synthetic peptide
  XENP022412 vhCDR2
EISTKANNHATYYAESVKG

SEQ ID NO: 32538 - protein, 10 aa, Artificial Sequence
  Description of Artificial Sequence: Synthetic peptide
  XENP022412 vhCDR3
LATWDWYFDV

SEQ ID NO: 32539 - protein, 218 aa, Artificial Sequence
  Description of Artificial Sequence: Synthetic polypeptide
  XENP022412 7G8_H3.18_L1.20_Fab Light Chain
DTVLTQSPSSLSASVGDRVTITCRASQSVDYDGDSYMNWYQQKPGQPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32540 - protein, 111 aa, Artificial Sequence
  Description of Artificial Sequence: Synthetic polypeptide
  VL of XENP022412
DTVLTQSPSSLSASVGDRVTITCRASQSVDYDGDSYMNWYQQKPGQPPKLLIYAASELESGIPARLSGSGSGTDFTLTISSLQPEDFATYYCQQSNEDPFTFGSGTKLEIK

SEQ ID NO: 32541 - protein, 15 aa, Artificial Sequence
  Description of Artificial Sequence: Synthetic peptide
  XENP022412 vlCDR1
RASQSVDYDGDSYMN

SEQ ID NO: 32542 - protein, 7 aa, Artificial Sequence
  Description of Artificial Sequence: Synthetic peptide
  XENP022412 vlCDR2
AASELES

SEQ ID NO: 32543 - protein, 9 aa, Artificial Sequence
  Description of Artificial Sequence: Synthetic peptide
  XENP022412 vlCDR3
QQSNEDPFT

SEQ ID NO: 32544 - protein, 226 aa, Artificial Sequence; identical to SEQ ID NO: 31734
  Description of Artificial Sequence: Synthetic polypeptide
  XENP022413 7G8_H3.18_L1.21_Fab Heavy Chain

SEQ ID NO: 32545 - protein, 121 aa, Artificial Sequence; identical to SEQ ID NO: 22325
  Description of Artificial Sequence: Synthetic polypeptide
  VH of XENP022413

SEQ ID NO: 32546 - protein, 5 aa, Artificial Sequence
  Description of Artificial Sequence: Synthetic peptide
  XENP022413 vhCDR1
DAWMD

SEQ ID NO: 32547 - protein, 19 aa, Artificial Sequence
  Description of Artificial Sequence: Synthetic peptide
  XENP022413 vhCDR2
EISTKANNHATYYAESVKG

SEQ ID NO: 32548 - protein, 10 aa, Artificial Sequence
  Description of Artificial Sequence: Synthetic peptide
  XENP022413 vhCDR3
LATWDWYFDV

SEQ ID NO: 32549 - protein, 218 aa, Artificial Sequence
  Description of Artificial Sequence: Synthetic polypeptide
  XENP022413 7G8_H3.18_L1.21_Fab Light Chain
DTVLTQSPSSLSASVGDRVTITCRASQSVDYDGDSYMNWYQQKPGLPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32550 - protein, 111 aa, Artificial Sequence
  Description of Artificial Sequence: Synthetic polypeptide
  VL of XENP022413
DTVLTQSPSSLSASVGDRVTITCRASQSVDYDGDSYMNWYQQKPGLPPKLLIYAASELESGIPARLSGSGSGTDFTLTISSLQPEDFATYYCQQSNEDPFTFGSGTKLEIK

SEQ ID NO: 32551 - protein, 15 aa, Artificial Sequence
  Description of Artificial Sequence: Synthetic peptide
  XENP022413 vlCDR1
RASQSVDYDGDSYMN

SEQ ID NO: 32552 - protein, 7 aa, Artificial Sequence
  Description of Artificial Sequence: Synthetic peptide
  XENP022413 vlCDR2
AASELES

SEQ ID NO: 32553 - protein, 9 aa, Artificial Sequence
  Description of Artificial Sequence: Synthetic peptide
  XENP022413 vlCDR3
QQSNEDPFT

SEQ ID NO: 32554 - protein, 226 aa, Artificial Sequence; identical to SEQ ID NO: 31734
  Description of Artificial Sequence: Synthetic polypeptide
  XENP022414 7G8_H3.18_L1.22_Fab Heavy Chain

SEQ ID NO: 32555 - protein, 121 aa, Artificial Sequence; identical to SEQ ID NO: 22325
  Description of Artificial Sequence: Synthetic polypeptide
  VH of XENP022414

SEQ ID NO: 32556 - protein, 5 aa, Artificial Sequence
  Description of Artificial Sequence: Synthetic peptide
  XENP022414 vhCDR1
DAWMD

SEQ ID NO: 32557 - protein, 19 aa, Artificial Sequence
  Description of Artificial Sequence: Synthetic peptide
  XENP022414 vhCDR2
EISTKANNHATYYAESVKG

SEQ ID NO: 32558 - protein, 10 aa, Artificial Sequence
  Description of Artificial Sequence: Synthetic peptide
  XENP022414 vhCDR3
LATWDWYFDV

SEQ ID NO: 32559 - protein, 218 aa, Artificial Sequence
  Description of Artificial Sequence: Synthetic polypeptide
  XENP022414 7G8_H3.18_L1.22_Fab Light Chain
DTVLTQSPSSLSASVGDRVTITCRASQSVDYDGDSYMNWYQQKPGEPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32560 - protein, 111 aa, Artificial Sequence
  Description of Artificial Sequence: Synthetic polypeptide
  VL of XENP022414
DTVLTQSPSSLSASVGDRVTITCRASQSVDYDGDSYMNWYQQKPGEPPKLLIYAASELESGIPARLSGSGSGTDFTLTISSLQPEDFATYYCQQSNEDPFTFGSGTKLEIK

SEQ ID NO: 32561 - protein, 15 aa, Artificial Sequence
  Description of Artificial Sequence: Synthetic peptide
  XENP022414 vlCDR1
RASQSVDYDGDSYMN

SEQ ID NO: 32562 - protein, 7 aa, Artificial Sequence
  Description of Artificial Sequence: Synthetic peptide
  XENP022414 vlCDR2
AASELES

SEQ ID NO: 32563 - protein, 9 aa, Artificial Sequence
  Description of Artificial Sequence: Synthetic peptide
  XENP022414 vlCDR3
QQSNEDPFT

SEQ ID NO: 32564 - protein, 226 aa, Artificial Sequence; identical to SEQ ID NO: 31734
  Description of Artificial Sequence: Synthetic polypeptide
  XENP022415 7G8_H3.18_L1.23_Fab Heavy Chain

SEQ ID NO: 32565 - protein, 121 aa, Artificial Sequence; identical to SEQ ID NO: 22325
  Description of Artificial Sequence: Synthetic polypeptide
  VH of XENP022415

SEQ ID NO: 32566 - protein, 5 aa, Artificial Sequence
  Description of Artificial Sequence: Synthetic peptide
  XENP022415 vhCDR1
DAWMD

SEQ ID NO: 32567 - protein, 19 aa, Artificial Sequence
  Description of Artificial Sequence: Synthetic peptide
  XENP022415 vhCDR2
EISTKANNHATYYAESVKG

SEQ ID NO: 32568 - protein, 10 aa, Artificial Sequence
  Description of Artificial Sequence: Synthetic peptide
  XENP022415 vhCDR3
LATWDWYFDV

SEQ ID NO: 32569 - protein, 218 aa, Artificial Sequence
  Description of Artificial Sequence: Synthetic polypeptide
  XENP022415 7G8_H3.18_L1.23_Fab Light Chain
DTVLTQSPSSLSASVGDRVTITCRASQSVDYDGDSYMNWYQQKPGKVPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32570 - protein, 111 aa, Artificial Sequence
  Description of Artificial Sequence: Synthetic polypeptide
  VL of XENP022415
DTVLTQSPSSLSASVGDRVTITCRASQSVDYDGDSYMNWYQQKPGKVPKLLIYAASELESGIPARLSGSGSGTDFTLTISSLQPEDFATYYCQQSNEDPFTFGSGTKLEIK

SEQ ID NO: 32571 - protein, 15 aa, Artificial Sequence
  Description of Artificial Sequence: Synthetic peptide
  XENP022415 vlCDR1
RASQSVDYDGDSYMN

SEQ ID NO: 32572 - protein, 7 aa, Artificial Sequence
  Description of Artificial Sequence: Synthetic peptide
  XENP022415 vlCDR2
AASELES

SEQ ID NO: 32573 - protein, 9 aa, Artificial Sequence
  Description of Artificial Sequence: Synthetic peptide
  XENP022415 vlCDR3
QQSNEDPFT

SEQ ID NO: 32574 - protein, 226 aa, Artificial Sequence; identical to SEQ ID NO: 31734
  Description of Artificial Sequence: Synthetic polypeptide
  XENP022416 7G8_H3.18_L1.24_Fab Heavy Chain

SEQ ID NO: 32575 - protein, 121 aa, Artificial Sequence; identical to SEQ ID NO: 22325
  Description of Artificial Sequence: Synthetic polypeptide
  VH of XENP022416

SEQ ID NO: 32576 - protein, 5 aa, Artificial Sequence
  Description of Artificial Sequence: Synthetic peptide
  XENP022416 vhCDR1
DAWMD

SEQ ID NO: 32577 - protein, 19 aa, Artificial Sequence
  Description of Artificial Sequence: Synthetic peptide
  XENP022416 vhCDR2
EISTKANNHATYYAESVKG

SEQ ID NO: 32578 - protein, 10 aa, Artificial Sequence
  Description of Artificial Sequence: Synthetic peptide
  XENP022416 vhCDR3
LATWDWYFDV

SEQ ID NO: 32579 - protein, 218 aa, Artificial Sequence
  Description of Artificial Sequence: Synthetic polypeptide
  XENP022416 7G8_H3.18_L1.24_Fab Light Chain
DTVLTQSPSSLSASVGDRVTITCRASQSVDYDGDSYMNWYQQKPGKAPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32580 - protein, 111 aa, Artificial Sequence
  Description of Artificial Sequence: Synthetic polypeptide
  VL of XENP022416
DTVLTQSPSSLSASVGDRVTITCRASQSVDYDGDSYMNWYQQKPGKAPKLLIYAASELESGIPARLSGSGSGTDFTLTISSLQPEDFATYYCQQSNEDPFTFGSGTKLEIK

SEQ ID NO: 32581 - protein, 15 aa, Artificial Sequence
  Description of Artificial Sequence: Synthetic peptide
  XENP022416 vlCDR1
RASQSVDYDGDSYMN

SEQ ID NO: 32582 - protein, 7 aa, Artificial Sequence
  Description of Artificial Sequence: Synthetic peptide
  XENP022416 vlCDR2
AASELES

SEQ ID NO: 32583 - protein, 9 aa, Artificial Sequence
  Description of Artificial Sequence: Synthetic peptide
  XENP022416 vlCDR3
QQSNEDPFT

SEQ ID NO: 32584 - protein, 226 aa, Artificial Sequence; identical to SEQ ID NO: 31734
  Description of Artificial Sequence: Synthetic polypeptide
  XENP022417 7G8_H3.18_L1.25_Fab Heavy Chain

SEQ ID NO: 32585 - protein, 121 aa, Artificial Sequence; identical to SEQ ID NO: 22325
  Description of Artificial Sequence: Synthetic polypeptide
  VH of XENP022417

SEQ ID NO: 32586 - protein, 5 aa, Artificial Sequence
  Description of Artificial Sequence: Synthetic peptide
  XENP022417 vhCDR1
DAWMD

SEQ ID NO: 32587 - protein, 19 aa, Artificial Sequence
  Description of Artificial Sequence: Synthetic peptide
  XENP022417 vhCDR2
EISTKANNHATYYAESVKG

SEQ ID NO: 32588 - protein, 10 aa, Artificial Sequence
  Description of Artificial Sequence: Synthetic peptide
  XENP022417 vhCDR3
LATWDWYFDV

SEQ ID NO: 32589 - protein, 218 aa, Artificial Sequence
  Description of Artificial Sequence: Synthetic polypeptide
  XENP022417 7G8_H3.18_L1.25_Fab Light Chain
DTVLTQSPSSLSASVGDRVTITCRASQSVDYDGDSYMNWYQQKPGKSPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32590 - protein, 111 aa, Artificial Sequence
  Description of Artificial Sequence: Synthetic polypeptide
  VL of XENP022417
DTVLTQSPSSLSASVGDRVTITCRASQSVDYDGDSYMNWYQQKPGKSPKLLIYAASELESGIPARLSGSGSGTDFTLTISSLQPEDFATYYCQQSNEDPFTFGSGTKLEIK

SEQ ID NO: 32591 - protein, 15 aa, Artificial Sequence
  Description of Artificial Sequence: Synthetic peptide
  XENP022417 vlCDR1
RASQSVDYDGDSYMN

SEQ ID NO: 32592 - protein, 7 aa, Artificial Sequence
  Description of Artificial Sequence: Synthetic peptide
  XENP022417 vlCDR2
AASELES

SEQ ID NO: 32593 - protein, 9 aa, Artificial Sequence
  Description of Artificial Sequence: Synthetic peptide
  XENP022417 vlCDR3
QQSNEDPFT

SEQ ID NO: 32594 - protein, 226 aa, Artificial Sequence; identical to SEQ ID NO: 31734
  Description of Artificial Sequence: Synthetic polypeptide
  XENP022418 7G8_H3.18_L1.26_Fab Heavy Chain

SEQ ID NO: 32595 - protein, 121 aa, Artificial Sequence; identical to SEQ ID NO: 22325
  Description of Artificial Sequence: Synthetic polypeptide
  VH of XENP022418

SEQ ID NO: 32596 - protein, 5 aa, Artificial Sequence
  Description of Artificial Sequence: Synthetic peptide
  XENP022418 vhCDR1
DAWMD

SEQ ID NO: 32597 - protein, 19 aa, Artificial Sequence
  Description of Artificial Sequence: Synthetic peptide
  XENP022418 vhCDR2
EISTKANNHATYYAESVKG

SEQ ID NO: 32598 - protein, 10 aa, Artificial Sequence
  Description of Artificial Sequence: Synthetic peptide
  XENP022418 vhCDR3
LATWDWYFDV

SEQ ID NO: 32599 - protein, 218 aa, Artificial Sequence
  Description of Artificial Sequence: Synthetic polypeptide
  XENP022418 7G8_H3.18_L1.26_Fab Light Chain
DTVLTQSPSSLSASVGDRVTITCRASQSVDYDGDSYMNWYQQKPGKPPKLLIYAASELESGVPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32600 - protein, 111 aa, Artificial Sequence
  Description of Artificial Sequence: Synthetic polypeptide
  VL of XENP022418
DTVLTQSPSSLSASVGDRVTITCRASQSVDYDGDSYMNWYQQKPGKPPKLLIYAASELESGVPARLSGSGSGTDFTLTISSLQPEDFATYYCQQSNEDPFTFGSGTKLEIK

SEQ ID NO: 32601 - protein, 15 aa, Artificial Sequence
  Description of Artificial Sequence: Synthetic peptide
  XENP022418 vlCDR1
RASQSVDYDGDSYMN

SEQ ID NO: 32602 - protein, 7 aa, Artificial Sequence
  Description of Artificial Sequence: Synthetic peptide
  XENP022418 vlCDR2
AASELES

SEQ ID NO: 32603 - protein, 9 aa, Artificial Sequence
  Description of Artificial Sequence: Synthetic peptide
  XENP022418 vlCDR3
QQSNEDPFT

SEQ ID NO: 32604 - protein, 226 aa, Artificial Sequence; identical to SEQ ID NO: 31734
  Description of Artificial Sequence: Synthetic polypeptide
  XENP022419 7G8_H3.18_L1.27_Fab Heavy Chain

SEQ ID NO: 32605 - protein, 121 aa, Artificial Sequence; identical to SEQ ID NO: 22325
  Description of Artificial Sequence: Synthetic polypeptide
  VH of XENP022419

SEQ ID NO: 32606 - protein, 5 aa, Artificial Sequence
  Description of Artificial Sequence: Synthetic peptide
  XENP022419 vhCDR1
DAWMD

SEQ ID NO: 32607 - protein, 19 aa, Artificial Sequence
  Description of Artificial Sequence: Synthetic peptide
  XENP022419 vhCDR2
EISTKANNHATYYAESVKG

SEQ ID NO: 32608 - protein, 10 aa, Artificial Sequence
  Description of Artificial Sequence: Synthetic peptide
  XENP022419 vhCDR3
LATWDWYFDV

SEQ ID NO: 32609 - protein, 218 aa, Artificial Sequence
  Description of Artificial Sequence: Synthetic polypeptide
  XENP022419 7G8_H3.18_L1.27_Fab Light Chain
DTVLTQSPSSLSASVGDRVTITCRASQSVDYDGDSYMNWYQQKPGKPPKLLIYAASELESGIPSRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32610 - protein, 111 aa, Artificial Sequence
  Description of Artificial Sequence: Synthetic polypeptide
  VL of XENP022419
DTVLTQSPSSLSASVGDRVTITCRASQSVDYDGDSYMNWYQQKPGKPPKLLIYAASELESGIPSRLSGSGSGTDFTLTISSLQPEDFATYYCQQSNEDPFTFGSGTKLEIK

SEQ ID NO: 32611 - protein, 15 aa, Artificial Sequence
  Description of Artificial Sequence: Synthetic peptide
  XENP022419 vlCDR1
RASQSVDYDGDSYMN

SEQ ID NO: 32612 - protein, 7 aa, Artificial Sequence
  Description of Artificial Sequence: Synthetic peptide
  XENP022419 vlCDR2
AASELES

SEQ ID NO: 32613 - protein, 9 aa, Artificial Sequence
  Description of Artificial Sequence: Synthetic peptide
  XENP022419 vlCDR3
QQSNEDPFT

SEQ ID NO: 32614 - protein, 226 aa, Artificial Sequence; identical to SEQ ID NO: 31734
  Description of Artificial Sequence: Synthetic polypeptide
  XENP022420 7G8_H3.18_L1.28_Fab Heavy Chain

SEQ ID NO: 32615 - protein, 121 aa, Artificial Sequence; identical to SEQ ID NO: 22325
  Description of Artificial Sequence: Synthetic polypeptide
  VH of XENP022420

SEQ ID NO: 32616 - protein, 5 aa, Artificial Sequence
  Description of Artificial Sequence: Synthetic peptide
  XENP022420 vhCDR1
DAWMD

SEQ ID NO: 32617 - protein, 19 aa, Artificial Sequence
  Description of Artificial Sequence: Synthetic peptide
  XENP022420 vhCDR2
EISTKANNHATYYAESVKG

SEQ ID NO: 32618 - protein, 10 aa, Artificial Sequence
  Description of Artificial Sequence: Synthetic peptide
  XENP022420 vhCDR3
LATWDWYFDV

SEQ ID NO: 32619 - protein, 218 aa, Artificial Sequence
  Description of Artificial Sequence: Synthetic polypeptide
  XENP022420 7G8_H3.18_L1.28_Fab Light Chain
DTVLTQSPSSLSASVGDRVTITCRASQSVDYDGDSYMNWYQQKPGKPPKLLIYAASELESGIPDRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32620 - protein, 111 aa, Artificial Sequence
  Description of Artificial Sequence: Synthetic polypeptide
  VL of XENP022420
DTVLTQSPSSLSASVGDRVTITCRASQSVDYDGDSYMNWYQQKPGKPPKLLIYAASELESGIPDRLSGSGSGTDFTLTISSLQPEDFATYYCQQSNEDPFTFGSGTKLEIK

SEQ ID NO: 32621 - protein, 15 aa, Artificial Sequence
  Description of Artificial Sequence: Synthetic peptide
  XENP022420 vlCDR1
RASQSVDYDGDSYMN

SEQ ID NO: 32622 - protein, 7 aa, Artificial Sequence
  Description of Artificial Sequence: Synthetic peptide
  XENP022420 vlCDR2
AASELES

SEQ ID NO: 32623 - protein, 9 aa, Artificial Sequence
  Description of Artificial Sequence: Synthetic peptide
  XENP022420 vlCDR3
QQSNEDPFT

SEQ ID NO: 32624 - protein, 226 aa, Artificial Sequence; identical to SEQ ID NO: 31734
  Description of Artificial Sequence: Synthetic polypeptide
  XENP022421 7G8_H3.18_L1.29_Fab Heavy Chain

SEQ ID NO: 32625 - protein, 121 aa, Artificial Sequence; identical to SEQ ID NO: 22325
  Description of Artificial Sequence: Synthetic polypeptide
  VH of XENP022421

SEQ ID NO: 32626 - protein, 5 aa, Artificial Sequence
  Description of Artificial Sequence: Synthetic peptide
  XENP022421 vhCDR1
DAWMD

SEQ ID NO: 32627 - protein, 19 aa, Artificial Sequence
  Description of Artificial Sequence: Synthetic peptide
  XENP022421 vhCDR2
EISTKANNHATYYAESVKG

SEQ ID NO: 32628 - protein, 10 aa, Artificial Sequence
  Description of Artificial Sequence: Synthetic peptide
  XENP022421 vhCDR3
LATWDWYFDV

SEQ ID NO: 32629 - protein, 218 aa, Artificial Sequence
  Description of Artificial Sequence: Synthetic polypeptide
  XENP022421 7G8_H3.18_L1.29_Fab Light Chain
DTVLTQSPSSLSASVGDRVTITCRASQSVDYDGDSYMNWYQQKPGKPPKLLIYAASELESGIPPRLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32630 - protein, 111 aa, Artificial Sequence
  Description of Artificial Sequence: Synthetic polypeptide
  VL of XENP022421
DTVLTQSPSSLSASVGDRVTITCRASQSVDYDGDSYMNWYQQKPGKPPKLLIYAASELESGIPPRLSGSGSGTDFTLTISSLQPEDFATYYCQQSNEDPFTFGSGTKLEIK

SEQ ID NO: 32631 - protein, 15 aa, Artificial Sequence
  Description of Artificial Sequence: Synthetic peptide
  XENP022421 vlCDR1
RASQSVDYDGDSYMN

SEQ ID NO: 32632 - protein, 7 aa, Artificial Sequence
  Description of Artificial Sequence: Synthetic peptide
  XENP022421 vlCDR2
AASELES

SEQ ID NO: 32633 - protein, 9 aa, Artificial Sequence
  Description of Artificial Sequence: Synthetic peptide
  XENP022421 vlCDR3
QQSNEDPFT

SEQ ID NO: 32634 - protein, 226 aa, Artificial Sequence; identical to SEQ ID NO: 31734
  Description of Artificial Sequence: Synthetic polypeptide
  XENP022422 7G8_H3.18_L1.30_Fab Heavy Chain

SEQ ID NO: 32635 - protein, 121 aa, Artificial Sequence; identical to SEQ ID NO: 22325
  Description of Artificial Sequence: Synthetic polypeptide
  VH of XENP022422

SEQ ID NO: 32636 - protein, 5 aa, Artificial Sequence
  Description of Artificial Sequence: Synthetic peptide
  XENP022422 vhCDR1
DAWMD

SEQ ID NO: 32637 - protein, 19 aa, Artificial Sequence
  Description of Artificial Sequence: Synthetic peptide
  XENP022422 vhCDR2
EISTKANNHATYYAESVKG

SEQ ID NO: 32638 - protein, 10 aa, Artificial Sequence
  Description of Artificial Sequence: Synthetic peptide
  XENP022422 vhCDR3
LATWDWYFDV

SEQ ID NO: 32639 - protein, 218 aa, Artificial Sequence; identical to SEQ ID NO: 22539
  Description of Artificial Sequence: Synthetic polypeptide
  XENP022422 7G8_H3.18_L1.30_Fab Light Chain

SEQ ID NO: 32640 - protein, 111 aa, Artificial Sequence; identical to SEQ ID NO: 22540
  Description of Artificial Sequence: Synthetic polypeptide
  VL of XENP022422

SEQ ID NO: 32641 - protein, 15 aa, Artificial Sequence
  Description of Artificial Sequence: Synthetic peptide
  XENP022422 vlCDR1
RASQSVDYDGDSYMN

SEQ ID NO: 32642 - protein, 7 aa, Artificial Sequence
  Description of Artificial Sequence: Synthetic peptide
  XENP022422 vlCDR2
AASELES

SEQ ID NO: 32643 - protein, 9 aa, Artificial Sequence
  Description of Artificial Sequence: Synthetic peptide
  XENP022422 vlCDR3
QQSNEDPFT

SEQ ID NO: 32644 - protein, 226 aa, Artificial Sequence; identical to SEQ ID NO: 31734
  Description of Artificial Sequence: Synthetic polypeptide
  XENP022423 7G8_H3.18_L1.31_Fab Heavy Chain

SEQ ID NO: 32645 - protein, 121 aa, Artificial Sequence; identical to SEQ ID NO: 22325
  Description of Artificial Sequence: Synthetic polypeptide
  VH of XENP022423

SEQ ID NO: 32646 - protein, 5 aa, Artificial Sequence
  Description of Artificial Sequence: Synthetic peptide
  XENP022423 vhCDR1
DAWMD

SEQ ID NO: 32647 - protein, 19 aa, Artificial Sequence
  Description of Artificial Sequence: Synthetic peptide
  XENP022423 vhCDR2
EISTKANNHATYYAESVKG

SEQ ID NO: 32648 - protein, 10 aa, Artificial Sequence
  Description of Artificial Sequence: Synthetic peptide
  XENP022423 vhCDR3
LATWDWYFDV

SEQ ID NO: 32649 - protein, 218 aa, Artificial Sequence
  Description of Artificial Sequence: Synthetic polypeptide
  XENP022423 7G8_H3.18_L1.31_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32650 - protein, 111 aa, Artificial Sequence
  Description of Artificial Sequence: Synthetic polypeptide
  VL of XENP022423
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGQGTKLEIK

SEQ ID NO: 32651 - protein, 15 aa, Artificial Sequence
  Description of Artificial Sequence: Synthetic peptide
  XENP022423 vlCDR1
RASQSVDYDGDSYMN

SEQ ID NO: 32652 - protein, 7 aa, Artificial Sequence
  Description of Artificial Sequence: Synthetic peptide
  XENP022423 vlCDR2
AASELES

SEQ ID NO: 32653 - protein, 9 aa, Artificial Sequence
  Description of Artificial Sequence: Synthetic peptide
  XENP022423 vlCDR3
QQSNEDPFT

SEQ ID NO: 32654 - protein, 226 aa, Artificial Sequence; identical to SEQ ID NO: 31734
  Description of Artificial Sequence: Synthetic polypeptide
  XENP022424 7G8_H3.18_L1.32_Fab Heavy Chain

SEQ ID NO: 32655 - protein, 121 aa, Artificial Sequence; identical to SEQ ID NO: 22325
  Description of Artificial Sequence: Synthetic polypeptide
  VH of XENP022424

SEQ ID NO: 32656 - protein, 5 aa, Artificial Sequence
  Description of Artificial Sequence: Synthetic peptide
  XENP022424 vhCDR1
DAWMD

SEQ ID NO: 32657 - protein, 19 aa, Artificial Sequence
  Description of Artificial Sequence: Synthetic peptide
  XENP022424 vhCDR2
EISTKANNHATYYAESVKG

SEQ ID NO: 32658 - protein, 10 aa, Artificial Sequence
  Description of Artificial Sequence: Synthetic peptide
  XENP022424 vhCDR3
LATWDWYFDV

SEQ ID NO: 32659 - protein, 218 aa, Artificial Sequence
  Description of Artificial Sequence: Synthetic polypeptide
  XENP022424 7G8_H3.18_L1.32_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGPGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32660 - protein, 111 aa, Artificial Sequence
  Description of Artificial Sequence: Synthetic polypeptide
  VL of XENP022424
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGPGTKLEIK

SEQ ID NO: 32661 - protein, 15 aa, Artificial Sequence
  Description of Artificial Sequence: Synthetic peptide
  XENP022424 vlCDR1
RASQSVDYDGDSYMN

SEQ ID NO: 32662 - protein, 7 aa, Artificial Sequence
  Description of Artificial Sequence: Synthetic peptide
  XENP022424 vlCDR2
AASELES

SEQ ID NO: 32663 - protein, 9 aa, Artificial Sequence
  Description of Artificial Sequence: Synthetic peptide
  XENP022424 vlCDR3
QQSNEDPFT

SEQ ID NO: 32664 - protein, 226 aa, Artificial Sequence; identical to SEQ ID NO: 31734
  Description of Artificial Sequence: Synthetic polypeptide
  XENP022425 7G8_H3.18_L1.33_Fab Heavy Chain

SEQ ID NO: 32665 - protein, 121 aa, Artificial Sequence; identical to SEQ ID NO: 22325
  Description of Artificial Sequence: Synthetic polypeptide
  VH of XENP022425

SEQ ID NO: 32666 - protein, 5 aa, Artificial Sequence
  Description of Artificial Sequence: Synthetic peptide
  XENP022425 vhCDR1
DAWMD

SEQ ID NO: 32667 - protein, 19 aa, Artificial Sequence
  Description of Artificial Sequence: Synthetic peptide
  XENP022425 vhCDR2
EISTKANNHATYYAESVKG

SEQ ID NO: 32668 - protein, 10 aa, Artificial Sequence
  Description of Artificial Sequence: Synthetic peptide
  XENP022425 vhCDR3
LATWDWYFDV

SEQ ID NO: 32669 - protein, 218 aa, Artificial Sequence
  Description of Artificial Sequence: Synthetic polypeptide
  XENP022425 7G8_H3.18_L1.33_Fab Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32670 - protein, 111 aa, Artificial Sequence
  Description of Artificial Sequence: Synthetic polypeptide
  VL of XENP022425
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGGGTKLEIK

SEQ ID NO: 32671 - protein, 15 aa, Artificial Sequence
  Description of Artificial Sequence: Synthetic peptide
  XENP022425 vlCDR1
RASQSVDYDGDSYMN

SEQ ID NO: 32672 - protein, 7 aa, Artificial Sequence
  Description of Artificial Sequence: Synthetic peptide
  XENP022425 vlCDR2
AASELES

SEQ ID NO: 32673 - protein, 9 aa, Artificial Sequence
  Description of Artificial Sequence: Synthetic peptide
  XENP022425 vlCDR3
QQSNEDPFT

SEQ ID NO: 32674 - protein, 226 aa, Artificial Sequence; identical to SEQ ID NO: 32254
  Description of Artificial Sequence: Synthetic polypeptide
  XENP022582 7G8_H3.30_L1.30_Fab Heavy Chain

SEQ ID NO: 32675 - protein, 121 aa, Artificial Sequence; identical to SEQ ID NO: 22485
  Description of Artificial Sequence: Synthetic polypeptide
  VH of XENP022582

SEQ ID NO: 32676 - protein, 5 aa, Artificial Sequence
  Description of Artificial Sequence: Synthetic peptide
  XENP022582 vhCDR1
DAWMS

SEQ ID NO: 32677 - protein, 19 aa, Artificial Sequence
  Description of Artificial Sequence: Synthetic peptide
  XENP022582 vhCDR2
EISTKANNHATYYAESVKG

SEQ ID NO: 32678 - protein, 10 aa, Artificial Sequence
  Description of Artificial Sequence: Synthetic peptide
  XENP022582 vhCDR3
LATWDWYFDV

SEQ ID NO: 32679 - protein, 218 aa, Artificial Sequence; identical to SEQ ID NO: 22539
  Description of Artificial Sequence: Synthetic polypeptide
  XENP022582 7G8_H3.30_L1.30_Fab Light Chain

SEQ ID NO: 32680 - protein, 111 aa, Artificial Sequence; identical to SEQ ID NO: 22540
  Description of Artificial Sequence: Synthetic polypeptide
  VL of XENP022582

SEQ ID NO: 32681 - protein, 15 aa, Artificial Sequence
  Description of Artificial Sequence: Synthetic peptide
  XENP022582 vlCDR1
RASQSVDYDGDSYMN

SEQ ID NO: 32682 - protein, 7 aa, Artificial Sequence
  Description of Artificial Sequence: Synthetic peptide
  XENP022582 vlCDR2
AASELES

SEQ ID NO: 32683 - protein, 9 aa, Artificial Sequence
  Description of Artificial Sequence: Synthetic peptide
  XENP022582 vlCDR3
QQSNEDPFT

SEQ ID NO: 32684 - protein, 226 aa, Artificial Sequence; identical to SEQ ID NO: 32284
  Description of Artificial Sequence: Synthetic polypeptide
  XENP022583 7G8_H3.33_L1.30_Fab Heavy Chain

SEQ ID NO: 32685 - protein, 121 aa, Artificial Sequence; identical to SEQ ID NO: 22505
  Description of Artificial Sequence: Synthetic polypeptide
  VH of XENP022583

SEQ ID NO: 32686 - protein, 5 aa, Artificial Sequence
  Description of Artificial Sequence: Synthetic peptide
  XENP022583 vhCDR1
DAWMG

SEQ ID NO: 32687 - protein, 19 aa, Artificial Sequence
  Description of Artificial Sequence: Synthetic peptide
  XENP022583 vhCDR2
EISTKANNHATYYAESVKG

SEQ ID NO: 32688 - protein, 10 aa, Artificial Sequence
  Description of Artificial Sequence: Synthetic peptide
  XENP022583 vhCDR3
LATWDWYFDV

SEQ ID NO: 32689 - protein, 218 aa, Artificial Sequence; identical to SEQ ID NO: 22539
  Description of Artificial Sequence: Synthetic polypeptide
  XENP022583 7G8_H3.33_L1.30_Fab Light Chain

SEQ ID NO: 32690 - protein, 111 aa, Artificial Sequence; identical to SEQ ID NO: 22540
  Description of Artificial Sequence: Synthetic polypeptide
  VL of XENP022583

SEQ ID NO: 32691 - protein, 15 aa, Artificial Sequence
  Description of Artificial Sequence: Synthetic peptide
  XENP022583 vlCDR1
RASQSVDYDGDSYMN

SEQ ID NO: 32692 - protein, 7 aa, Artificial Sequence
  Description of Artificial Sequence: Synthetic peptide
  XENP022583 vlCDR2
AASELES

SEQ ID NO: 32693 - protein, 9 aa, Artificial Sequence
  Description of Artificial Sequence: Synthetic peptide
  XENP022583 vlCDR3
QQSNEDPFT

SEQ ID NO: 32694 - protein, 226 aa, Artificial Sequence
  Description of Artificial Sequence: Synthetic polypeptide
  XENP022588 7G8_H3.54_L1.30_Fab Heavy Chain
EVQLVESGGGLVQPGGSLRLSCAASGFTFDDAWMSWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32695 - protein, 121 aa, Artificial Sequence
  Description of Artificial Sequence: Synthetic polypeptide
  VH of XENP022588
EVQLVESGGGLVQPGGSLRLSCAASGFTFDDAWMSWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32696 - protein, 5 aa, Artificial Sequence
  Description of Artificial Sequence: Synthetic peptide
  XENP022588 vhCDR1
DAWMS

SEQ ID NO: 32697 - protein, 19 aa, Artificial Sequence
  Description of Artificial Sequence: Synthetic peptide
  XENP022588 vhCDR2
EISTKANNHATYYAPSVKG

SEQ ID NO: 32698 - protein, 10 aa, Artificial Sequence
  Description of Artificial Sequence: Synthetic peptide
  XENP022588 vhCDR3
LATWDWYFDV

SEQ ID NO: 32699 - protein, 218 aa, Artificial Sequence; identical to SEQ ID NO: 22539
  Description of Artificial Sequence: Synthetic polypeptide
  XENP022588 7G8_H3.54_L1.30_Fab Light Chain

SEQ ID NO: 32700 - protein, 111 aa, Artificial Sequence; identical to SEQ ID NO: 22540
  Description of Artificial Sequence: Synthetic polypeptide
  VL of XENP022588

SEQ ID NO: 32701 - protein, 15 aa, Artificial Sequence
  Description of Artificial Sequence: Synthetic peptide
  XENP022588 vlCDR1
RASQSVDYDGDSYMN

SEQ ID NO: 32702 - protein, 7 aa, Artificial Sequence
  Description of Artificial Sequence: Synthetic peptide
  XENP022588 vlCDR2
AASELES

SEQ ID NO: 32703 - protein, 9 aa, Artificial Sequence
  Description of Artificial Sequence: Synthetic peptide
  XENP022588 vlCDR3
QQSNEDPFT

SEQ ID NO: 32704 - protein, 226 aa, Artificial Sequence
  Description of Artificial Sequence: Synthetic polypeptide
  XENP022589 7G8_H3.55_L1.30_Fab Heavy Chain
EVQLVESGGGLVQPGGSLRLSCAASGFTFDDAWMGWVRQAPGKGLEWVAEISTKANNHATYYAPSVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32705 - protein, 121 aa, Artificial Sequence
  Description of Artificial Sequence: Synthetic polypeptide
  VH of XENP022589
EVQLVESGGGLVQPGGSLRLSCAASGFTFDDAWMGWVRQAPGKGLEWVAEISTKANNHATYYAPSVKGRFTISRDDSKSSVYLQMNSLRAEDTAVYYCTRLATWDWYFDVWGQGTTVTVSS

SEQ ID NO: 32706 - protein, 5 aa, Artificial Sequence
  Description of Artificial Sequence: Synthetic peptide
  XENP022589 vhCDR1
DAWMG

SEQ ID NO: 32707 - protein, 19 aa, Artificial Sequence
  Description of Artificial Sequence: Synthetic peptide
  XENP022589 vhCDR2
EISTKANNHATYYAPSVKG

SEQ ID NO: 32708 - protein, 10 aa, Artificial Sequence
  Description of Artificial Sequence: Synthetic peptide
  XENP022589 vhCDR3
LATWDWYFDV

SEQ ID NO: 32709 - protein, 218 aa, Artificial Sequence; identical to SEQ ID NO: 22539
  Description of Artificial Sequence: Synthetic polypeptide
  XENP022589 7G8_H3.55_L1.30_Fab Light Chain

SEQ ID NO: 32710 - protein, 111 aa, Artificial Sequence; identical to SEQ ID NO: 22540
  Description of Artificial Sequence: Synthetic polypeptide
  VL of XENP022589

SEQ ID NO: 32711 - protein, 15 aa, Artificial Sequence
  Description of Artificial Sequence: Synthetic peptide
  XENP022589 vlCDR1
RASQSVDYDGDSYMN

SEQ ID NO: 32712 - protein, 7 aa, Artificial Sequence
  Description of Artificial Sequence: Synthetic peptide
  XENP022589 vlCDR2
AASELES

SEQ ID NO: 32713 - protein, 9 aa, Artificial Sequence
  Description of Artificial Sequence: Synthetic peptide
  XENP022589 vlCDR3
QQSNEDPFT

SEQ ID NO: 32714 - protein, 226 aa, Artificial Sequence
  Description of Artificial Sequence: Synthetic polypeptide
  XENP022590 7G8_H3.56_L1.30_Fab Heavy Chain
EVQLVESGGGLVQPGGSLRLSCAASGFTFDDAWMSWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32715 - protein, 121 aa, Artificial Sequence
  Description of Artificial Sequence: Synthetic polypeptide
  VH of XENP022590
EVQLVESGGGLVQPGGSLRLSCAASGFTFDDAWMSWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32716 - protein, 5 aa, Artificial Sequence
  Description of Artificial Sequence: Synthetic peptide
  XENP022590 vhCDR1
DAWMS

SEQ ID NO: 32717 - protein, 19 aa, Artificial Sequence
  Description of Artificial Sequence: Synthetic peptide
  XENP022590 vhCDR2
EISTKANNHATYYAESVKG

SEQ ID NO: 32718 - protein, 10 aa, Artificial Sequence
  Description of Artificial Sequence: Synthetic peptide
  XENP022590 vhCDR3
LATWDWYFDV

SEQ ID NO: 32719 - protein, 218 aa, Artificial Sequence; identical to SEQ ID NO: 22539
  Description of Artificial Sequence: Synthetic polypeptide
  XENP022590 7G8_H3.56_L1.30_Fab Light Chain

SEQ ID NO: 32720 - protein, 111 aa, Artificial Sequence; identical to SEQ ID NO: 22540
  Description of Artificial Sequence: Synthetic polypeptide
  VL of XENP022590

SEQ ID NO: 32721 - protein, 15 aa, Artificial Sequence
  Description of Artificial Sequence: Synthetic peptide
  XENP022590 vlCDR1
RASQSVDYDGDSYMN

SEQ ID NO: 32722 - protein, 7 aa, Artificial Sequence
  Description of Artificial Sequence: Synthetic peptide
  XENP022590 vlCDR2
AASELES

SEQ ID NO: 32723 - protein, 9 aa, Artificial Sequence
  Description of Artificial Sequence: Synthetic peptide
  XENP022590 vlCDR3
QQSNEDPFT

SEQ ID NO: 32724 - protein, 226 aa, Artificial Sequence
  Description of Artificial Sequence: Synthetic polypeptide
  XENP022591 7G8_H3.57_L1.30_Fab Heavy Chain
EVQLVESGGGLVQPGGSLRLSCAASGFTFDDAWMGWVRQAPGKGLEWVAEISTKANNHATYYAESVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32725 - protein, 121 aa, Artificial Sequence
  Description of Artificial Sequence: Synthetic polypeptide
  VH of XENP022591
EVQLVESGGGLVQPGGSLRLSCAASGFTFDDAWMGWVRQAPGKGLEWVAEISTKANNHATYYAESVKGRFTISRDDSKSTVYLQMNSLRAEDTAVYYCTRLATWDWYFDVWGQGTTVTVSS

SEQ ID NO: 32726 - protein, 5 aa, Artificial Sequence
  Description of Artificial Sequence: Synthetic peptide
  XENP022591 vhCDR1
DAWMG

SEQ ID NO: 32727 - protein, 19 aa, Artificial Sequence
  Description of Artificial Sequence: Synthetic peptide
  XENP022591 vhCDR2
EISTKANNHATYYAESVKG

SEQ ID NO: 32728 - protein, 10 aa, Artificial Sequence
  Description of Artificial Sequence: Synthetic peptide
  XENP022591 vhCDR3
LATWDWYFDV

SEQ ID NO: 32729 - protein, 218 aa, Artificial Sequence; identical to SEQ ID NO: 22539
  Description of Artificial Sequence: Synthetic polypeptide
  XENP022591 7G8_H3.57_L1.30_Fab Light Chain

SEQ ID NO: 32730 - protein, 111 aa, Artificial Sequence; identical to SEQ ID NO: 22540
  Description of Artificial Sequence: Synthetic polypeptide
  VL of XENP022591

SEQ ID NO: 32731 - protein, 15 aa, Artificial Sequence
  Description of Artificial Sequence: Synthetic peptide
  XENP022591 vlCDR1
RASQSVDYDGDSYMN

SEQ ID NO: 32732 - protein, 7 aa, Artificial Sequence
  Description of Artificial Sequence: Synthetic peptide
  XENP022591 vlCDR2
AASELES

SEQ ID NO: 32733 - protein, 9 aa, Artificial Sequence
  Description of Artificial Sequence: Synthetic peptide
  XENP022591 vlCDR3
QQSNEDPFT

SEQ ID NO: 32734 - protein, 226 aa, Artificial Sequence
  Description of Artificial Sequence: Synthetic polypeptide
  XENP022592 7G8_H3.58_L1.30_Fab Heavy Chain
EVQLVESGGGLVQPGGSLRLSCAASGFTFDDAWMSWVRQAPGKGLEWVAEISTKANNHATYYAPSVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32735 - protein, 121 aa, Artificial Sequence
  Description of Artificial Sequence: Synthetic polypeptide
  VH of XENP022592
EVQLVESGGGLVQPGGSLRLSCAASGFTFDDAWMSWVRQAPGKGLEWVAEISTKANNHATYYAPSVKGRFTISRDDSKSTVYLQMNSLRAEDTAVYYCTRLATWDWYFDVWGQGTTVTVSS

SEQ ID NO: 32736 - protein, 5 aa, Artificial Sequence
  Description of Artificial Sequence: Synthetic peptide
  XENP022592 vhCDR1
DAWMS

SEQ ID NO: 32737 - protein, 19 aa, Artificial Sequence
  Description of Artificial Sequence: Synthetic peptide
  XENP022592 vhCDR2
EISTKANNHATYYAPSVKG

SEQ ID NO: 32738 - protein, 10 aa, Artificial Sequence
  Description of Artificial Sequence: Synthetic peptide
  XENP022592 vhCDR3
LATWDWYFDV

SEQ ID NO: 32739 - protein, 218 aa, Artificial Sequence; identical to SEQ ID NO: 22539
  Description of Artificial Sequence: Synthetic polypeptide
  XENP022592 7G8_H3.58_L1.30_Fab Light Chain

SEQ ID NO: 32740 - protein, 111 aa, Artificial Sequence; identical to SEQ ID NO: 22540
  Description of Artificial Sequence: Synthetic polypeptide
  VL of XENP022592

SEQ ID NO: 32741 - protein, 15 aa, Artificial Sequence
  Description of Artificial Sequence: Synthetic peptide
  XENP022592 vlCDR1
RASQSVDYDGDSYMN

SEQ ID NO: 32742 - protein, 7 aa, Artificial Sequence
  Description of Artificial Sequence: Synthetic peptide
  XENP022592 vlCDR2
AASELES

SEQ ID NO: 32743 - protein, 9 aa, Artificial Sequence
  Description of Artificial Sequence: Synthetic peptide
  XENP022592 vlCDR3
QQSNEDPFT

SEQ ID NO: 32744 - protein, 226 aa, Artificial Sequence
  Description of Artificial Sequence: Synthetic polypeptide
  XENP022593 7G8_H3.59_L1.30_Fab Heavy Chain
EVQLVESGGGLVQPGGSLRLSCAASGFTFDDAWMGWVRQAPGKGLEWVAEISTKANNHATYYAPSVKGRFTISRDDSKSTVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 32745 - protein, 121 aa, Artificial Sequence
  Description of Artificial Sequence: Synthetic polypeptide
  VH of XENP022593
EVQLVESGGGLVQPGGSLRLSCAASGFTFDDAWMGWVRQAPGKGLEWVAEISTKANNHATYYAPSVKGRFTISRDDSKSTVYLQMNSLRAEDTAVYYCTRLATWDWYFDVWGQGTTVTVSS

SEQ ID NO: 32746 - protein, 5 aa, Artificial Sequence
  Description of Artificial Sequence: Synthetic peptide
  XENP022593 vhCDR1
DAWMG

SEQ ID NO: 32747 - protein, 19 aa, Artificial Sequence
  Description of Artificial Sequence: Synthetic peptide
  XENP022593 vhCDR2
EISTKANNHATYYAPSVKG

SEQ ID NO: 32748 - protein, 10 aa, Artificial Sequence
  Description of Artificial Sequence: Synthetic peptide
  XENP022593 vhCDR3
LATWDWYFDV

SEQ ID NO: 32749 - protein, 218 aa, Artificial Sequence; identical to SEQ ID NO: 22539
  Description of Artificial Sequence: Synthetic polypeptide
  XENP022593 7G8_H3.59_L1.30_Fab Light Chain

SEQ ID NO: 32750 - protein, 111 aa, Artificial Sequence; identical to SEQ ID NO: 22540
  Description of Artificial Sequence: Synthetic polypeptide
  VL of XENP022593

SEQ ID NO: 32751 - protein, 15 aa, Artificial Sequence
  Description of Artificial Sequence: Synthetic peptide
  XENP022593 vlCDR1
RASQSVDYDGDSYMN

SEQ ID NO: 32752 - protein, 7 aa, Artificial Sequence
  Description of Artificial Sequence: Synthetic peptide
  XENP022593 vlCDR2
AASELES

SEQ ID NO: 32753 - protein, 9 aa, Artificial Sequence
  Description of Artificial Sequence: Synthetic peptide
  XENP022593 vlCDR3
QQSNEDPFT

SEQ ID NO: 32754 - protein, 226 aa, Artificial Sequence; identical to SEQ ID NO: 32254
  Description of Artificial Sequence: Synthetic polypeptide
  XENP022594 7G8_H3.30_L1.34_Fab Heavy Chain

SEQ ID NO: 32755 - protein, 121 aa, Artificial Sequence; identical to SEQ ID NO: 22485
  Description of Artificial Sequence: Synthetic polypeptide
  VH of XENP022594

SEQ ID NO: 32756 - protein, 5 aa, Artificial Sequence
  Description of Artificial Sequence: Synthetic peptide
  XENP022594 vhCDR1
DAWMS

SEQ ID NO: 32757 - protein, 19 aa, Artificial Sequence
  Description of Artificial Sequence: Synthetic peptide
  XENP022594 vhCDR2
EISTKANNHATYYAESVKG

SEQ ID NO: 32758 - protein, 10 aa, Artificial Sequence
  Description of Artificial Sequence: Synthetic peptide
  XENP022594 vhCDR3
LATWDWYFDV

SEQ ID NO: 32759 - protein, 218 aa, Artificial Sequence; identical to SEQ ID NO: 22599
  Description of Artificial Sequence: Synthetic polypeptide
  XENP022594 7G8_H3.30_L1.34_Fab Light Chain

SEQ ID NO: 32760 - protein, 111 aa, Artificial Sequence; identical to SEQ ID NO: 22600
  Description of Artificial Sequence: Synthetic polypeptide
  VL of XENP022594

SEQ ID NO: 32761 - protein, 15 aa, Artificial Sequence
  Description of Artificial Sequence: Synthetic peptide
  XENP022594 vlCDR1
RASQSVDYDGDSYMN

SEQ ID NO: 32762 - protein, 7 aa, Artificial Sequence
  Description of Artificial Sequence: Synthetic peptide
  XENP022594 vlCDR2
AASELES

SEQ ID NO: 32763 - protein, 9 aa, Artificial Sequence
  Description of Artificial Sequence: Synthetic peptide
  XENP022594 vlCDR3
QQSNEDPFT

SEQ ID NO: 32764 - protein, 226 aa, Artificial Sequence; identical to SEQ ID NO: 32254
  Description of Artificial Sequence: Synthetic polypeptide
  XENP022595 7G8_H3.30_L1.36_Fab Heavy Chain

SEQ ID NO: 32765 - protein, 121 aa, Artificial Sequence; identical to SEQ ID NO: 22485
  Description of Artificial Sequence: Synthetic polypeptide
  VH of XENP022595

SEQ ID NO: 32766 - protein, 5 aa, Artificial Sequence
  Description of Artificial Sequence: Synthetic peptide
  XENP022595 vhCDR1
DAWMS

SEQ ID NO: 32767 - protein, 19 aa, Artificial Sequence
  Description of Artificial Sequence: Synthetic peptide
  XENP022595 vhCDR2
EISTKANNHATYYAESVKG

SEQ ID NO: 32768 - protein, 10 aa, Artificial Sequence
  Description of Artificial Sequence: Synthetic peptide
  XENP022595 vhCDR3
LATWDWYFDV

SEQ ID NO: 32769 - protein, 218 aa, Artificial Sequence; identical to SEQ ID NO: 22619
  Description of Artificial Sequence: Synthetic polypeptide
  XENP022595 7G8_H3.30_L1.36_Fab Light Chain

SEQ ID NO: 32770 - protein, 111 aa, Artificial Sequence; identical to SEQ ID NO: 22620
  Description of Artificial Sequence: Synthetic polypeptide
  VL of XENP022595

SEQ ID NO: 32771 - protein, 15 aa, Artificial Sequence
  Description of Artificial Sequence: Synthetic peptide
  XENP022595 vlCDR1
RASQSVDHDGDSYMN

SEQ ID NO: 32772 - protein, 7 aa, Artificial Sequence
  Description of Artificial Sequence: Synthetic peptide
  XENP022595 vlCDR2
AASELES

SEQ ID NO: 32773 - protein, 9 aa, Artificial Sequence
  Description of Artificial Sequence: Synthetic peptide
  XENP022595 vlCDR3
QQSNEDPFT

SEQ ID NO: 32774 - protein, 226 aa, Artificial Sequence; identical to SEQ ID NO: 32284
  Description of Artificial Sequence: Synthetic polypeptide
  XENP022596 7G8_H3.33_L1.34_Fab Heavy Chain

SEQ ID NO: 32775 - protein, 121 aa, Artificial Sequence; identical to SEQ ID NO: 22505
  Description of Artificial Sequence: Synthetic polypeptide
  VH of XENP022596

SEQ ID NO: 32776 - protein, 5 aa, Artificial Sequence
  Description of Artificial Sequence: Synthetic peptide
  XENP022596 vhCDR1
DAWMG

SEQ ID NO: 32777 - protein, 19 aa, Artificial Sequence
  Description of Artificial Sequence: Synthetic peptide
  XENP022596 vhCDR2
EISTKANNHATYYAESVKG

SEQ ID NO: 32778 - protein, 10 aa, Artificial Sequence
  Description of Artificial Sequence: Synthetic peptide
  XENP022596 vhCDR3
LATWDWYFDV

SEQ ID NO: 32779 - protein, 218 aa, Artificial Sequence; identical to SEQ ID NO: 22599
  Description of Artificial Sequence: Synthetic polypeptide
  XENP022596 7G8_H3.33_L1.34_Fab Light Chain

SEQ ID NO: 32780 - protein, 111 aa, Artificial Sequence; identical to SEQ ID NO: 22600
  Description of Artificial Sequence: Synthetic polypeptide
  VL of XENP022596

SEQ ID NO: 32781 - protein, 15 aa, Artificial Sequence
  Description of Artificial Sequence: Synthetic peptide
  XENP022596 vlCDR1
RASQSVDYDGDSYMN

SEQ ID NO: 32782 - protein, 7 aa, Artificial Sequence
  Description of Artificial Sequence: Synthetic peptide
  XENP022596 vlCDR2
AASELES

SEQ ID NO: 32783 - protein, 9 aa, Artificial Sequence
  Description of Artificial Sequence: Synthetic peptide
  XENP022596 vlCDR3
QQSNEDPFT

SEQ ID NO: 32784 - protein, 226 aa, Artificial Sequence; identical to SEQ ID NO: 32284
  Description of Artificial Sequence: Synthetic polypeptide
  XENP022601 7G8_H3.33_L1.36_Fab Heavy Chain

SEQ ID NO: 32785 - protein, 121 aa, Artificial Sequence; identical to SEQ ID NO: 22505
  Description of Artificial Sequence: Synthetic polypeptide
  VH of XENP022601

SEQ ID NO: 32786 - protein, 5 aa, Artificial Sequence
  Description of Artificial Sequence: Synthetic peptide
  XENP022601 vhCDR1
DAWMG

SEQ ID NO: 32787 - protein, 19 aa, Artificial Sequence
  Description of Artificial Sequence: Synthetic peptide
  XENP022601 vhCDR2
EISTKANNHATYYAESVKG

SEQ ID NO: 32788 - protein, 10 aa, Artificial Sequence
  Description of Artificial Sequence: Synthetic peptide
  XENP022601 vhCDR3
LATWDWYFDV

SEQ ID NO: 32789 - protein, 218 aa, Artificial Sequence; identical to SEQ ID NO: 22619
  Description of Artificial Sequence: Synthetic polypeptide
  XENP022601 7G8_H3.33_L1.36_Fab Light Chain

SEQ ID NO: 32790 - protein, 111 aa, Artificial Sequence; identical to SEQ ID NO: 22620
  Description of Artificial Sequence: Synthetic polypeptide
  VL of XENP022601

SEQ ID NO: 32791 - protein, 15 aa, Artificial Sequence
  Description of Artificial Sequence: Synthetic peptide
  XENP022601 vlCDR1
RASQSVDHDGDSYMN

SEQ ID NO: 32792 - protein, 7 aa, Artificial Sequence
  Description of Artificial Sequence: Synthetic peptide
  XENP022601 vlCDR2
AASELES

SEQ ID NO: 32793 - protein, 9 aa, Artificial Sequence
  Description of Artificial Sequence: Synthetic peptide
  XENP022601 vlCDR3
QQSNEDPFT

SEQ ID NO: 32794 - protein, 447 aa, Artificial Sequence; identical to SEQ ID NO: 22064
  Description of Artificial Sequence: Synthetic polypeptide
  XENP022511 2A11_H1.125_L2.113-one-arm Fab-Fc Heavy Chain

SEQ ID NO: 32795 - protein, 118 aa, Artificial Sequence; identical to SEQ ID NO: 22065
  Description of Artificial Sequence: Synthetic polypeptide
  VH of XENP022511

SEQ ID NO: 32796 - protein, 5 aa, Artificial Sequence
  Description of Artificial Sequence: Synthetic peptide
  XENP022511 vhCDR1
HYFMH

SEQ ID NO: 32797 - protein, 17 aa, Artificial Sequence
  Description of Artificial Sequence: Synthetic peptide
  XENP022511 vhCDR2
WIDPYLGDTEYAPKFQG

SEQ ID NO: 32798 - protein, 9 aa, Artificial Sequence
  Description of Artificial Sequence: Synthetic peptide
  XENP022511 vhCDR3
RGVYQALDY

SEQ ID NO: 32799 - protein, 231 aa, Artificial Sequence
  Description of Artificial Sequence: Synthetic polypeptide
  XENP022511 2A11_H1.125_L2.113-one-arm Fc only Heavy Chain
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32800 - protein, 214 aa, Artificial Sequence; identical to SEQ ID NO: 22079
  Description of Artificial Sequence: Synthetic polypeptide
  XENP022511 2A11_H1.125_L2.113-one-arm Light Chain

SEQ ID NO: 32801 - protein, 107 aa, Artificial Sequence; identical to SEQ ID NO: 22080
  Description of Artificial Sequence: Synthetic polypeptide
  VL of XENP022511

SEQ ID NO: 32802 - protein, 11 aa, Artificial Sequence
  Description of Artificial Sequence: Synthetic peptide
  XENP022511 vlCDR1
QASQDIGNYLN

SEQ ID NO: 32803 - protein, 7 aa, Artificial Sequence
  Description of Artificial Sequence: Synthetic peptide
  XENP022511 vlCDR2
FTSYLHS

SEQ ID NO: 32804 - protein, 9 aa, Artificial Sequence
  Description of Artificial Sequence: Synthetic peptide
  XENP022511 vlCDR3
QQGNTLPYT

SEQ ID NO: 32805 - protein, 447 aa, Artificial Sequence; identical to SEQ ID NO: 22084
  Description of Artificial Sequence: Synthetic polypeptide
  XENP022512 2A11_H1.144_L2.113-one-arm Fab-Fc Heavy Chain

SEQ ID NO: 32806 - protein, 118 aa, Artificial Sequence; identical to SEQ ID NO: 22085
  Description of Artificial Sequence: Synthetic polypeptide
  VH of XENP022512

SEQ ID NO: 32807 - protein, 5 aa, Artificial Sequence
  Description of Artificial Sequence: Synthetic peptide
  XENP022512 vhCDR1
DYFMH

SEQ ID NO: 32808 - protein, 17 aa, Artificial Sequence
  Description of Artificial Sequence: Synthetic peptide
  XENP022512 vhCDR2
WIDPELGDTEYAPKFQG

SEQ ID NO: 32809 - protein, 9 aa, Artificial Sequence
  Description of Artificial Sequence: Synthetic peptide
  XENP022512 vhCDR3
RGVYQALDY

SEQ ID NO: 32810 - protein, 231 aa, Artificial Sequence; identical to SEQ ID NO: 32799
  Description of Artificial Sequence: Synthetic polypeptide
  XENP022512 2A11_H1.144_L2.113-one-arm Fc only Heavy Chain

SEQ ID NO: 32811 - protein, 214 aa, Artificial Sequence; identical to SEQ ID NO: 22079
  Description of Artificial Sequence: Synthetic polypeptide
  XENP022512 2A11_H1.144_L2.113-one-arm Light Chain

SEQ ID NO: 32812 - protein, 107 aa, Artificial Sequence; identical to SEQ ID NO: 22080
  Description of Artificial Sequence: Synthetic polypeptide
  VL of XENP022512

SEQ ID NO: 32813 - protein, 11 aa, Artificial Sequence
  Description of Artificial Sequence: Synthetic peptide
  XENP022512 vlCDR1
QASQDIGNYLN

SEQ ID NO: 32814 - protein, 7 aa, Artificial Sequence
  Description of Artificial Sequence: Synthetic peptide
  XENP022512 vlCDR2
FTSYLHS

SEQ ID NO: 32815 - protein, 9 aa, Artificial Sequence
  Description of Artificial Sequence: Synthetic peptide
  XENP022512 vlCDR3
QQGNTLPYT

SEQ ID NO: 32816 - protein, 447 aa, Artificial Sequence; identical to SEQ ID NO: 22104
  Description of Artificial Sequence: Synthetic polypeptide
  XENP022513 2A11_H1.117_L2.116-one-arm Fab-Fc Heavy Chain

SEQ ID NO: 32817 - protein, 118 aa, Artificial Sequence; identical to SEQ ID NO: 22105
  Description of Artificial Sequence: Synthetic polypeptide
  VH of XENP022513

SEQ ID NO: 32818 - protein, 5 aa, Artificial Sequence
  Description of Artificial Sequence: Synthetic peptide
  XENP022513 vhCDR1
HYFMH

SEQ ID NO: 32819 - protein, 17 aa, Artificial Sequence
  Description of Artificial Sequence: Synthetic peptide
  XENP022513 vhCDR2
WIDPYLGDTEYAPKFQG

SEQ ID NO: 32820 - protein, 9 aa, Artificial Sequence
  Description of Artificial Sequence: Synthetic peptide
  XENP022513 vhCDR3
RGVRQALDY

SEQ ID NO: 32821 - protein, 231 aa, Artificial Sequence; identical to SEQ ID NO: 32799
  Description of Artificial Sequence: Synthetic polypeptide
  XENP022513 2A11_H1.117_L2.116-one-arm Fc only Heavy Chain

SEQ ID NO: 32822 - protein, 214 aa, Artificial Sequence; identical to SEQ ID NO: 22119
  Description of Artificial Sequence: Synthetic polypeptide
  XENP022513 2A11_H1.117_L2.116-one-arm Light Chain

SEQ ID NO: 32823 - protein, 107 aa, Artificial Sequence; identical to SEQ ID NO: 22120
  Description of Artificial Sequence: Synthetic polypeptide
  VL of XENP022513

SEQ ID NO: 32824 - protein, 11 aa, Artificial Sequence
  Description of Artificial Sequence: Synthetic peptide
  XENP022513 vlCDR1
QASQDIGNYLN

SEQ ID NO: 32825 - protein, 7 aa, Artificial Sequence
  Description of Artificial Sequence: Synthetic peptide
  XENP022513 vlCDR2
FTSHLHS

SEQ ID NO: 32826 - protein, 9 aa, Artificial Sequence
  Description of Artificial Sequence: Synthetic peptide
  XENP022513 vlCDR3
QQGHQLPYT

SEQ ID NO: 32827 - protein, 447 aa, Artificial Sequence; identical to SEQ ID NO: 22084
  Description of Artificial Sequence: Synthetic polypeptide
  XENP022514 2A11_H1.144_L2-one-arm Fab-Fc Heavy Chain

SEQ ID NO: 32828 - protein, 118 aa, Artificial Sequence; identical to SEQ ID NO: 22085
  Description of Artificial Sequence: Synthetic polypeptide
  VH of XENP022514

SEQ ID NO: 32829 - protein, 5 aa, Artificial Sequence
  Description of Artificial Sequence: Synthetic peptide
  XENP022514 vhCDR1
DYFMH

SEQ ID NO: 32830 - protein, 17 aa, Artificial Sequence
  Description of Artificial Sequence: Synthetic peptide
  XENP022514 vhCDR2
WIDPELGDTEYAPKFQG

SEQ ID NO: 32831 - protein, 9 aa, Artificial Sequence
  Description of Artificial Sequence: Synthetic peptide
  XENP022514 vhCDR3
RGVYQALDY

SEQ ID NO: 32832 - protein, 231 aa, Artificial Sequence; identical to SEQ ID NO: 32799
  Description of Artificial Sequence: Synthetic polypeptide
  XENP022514 2A11_H1.144_L2-one-arm Fc only Heavy Chain

SEQ ID NO: 32833 - protein, 214 aa, Artificial Sequence; identical to SEQ ID NO: 17250
  Description of Artificial Sequence: Synthetic polypeptide
  XENP022514 2A11_H1.144_L2-one-arm Light Chain

SEQ ID NO: 32834 - protein, 107 aa, Artificial Sequence; identical to SEQ ID NO: 17251
  Description of Artificial Sequence: Synthetic polypeptide
  VL of XENP022514

SEQ ID NO: 32835 - protein, 11 aa, Artificial Sequence
  Description of Artificial Sequence: Synthetic peptide
  XENP022514 vlCDR1
QASQDIGNYLN

SEQ ID NO: 32836 - protein, 7 aa, Artificial Sequence
  Description of Artificial Sequence: Synthetic peptide
  XENP022514 vlCDR2
YTSRLHS

SEQ ID NO: 32837 - protein, 9 aa, Artificial Sequence
  Description of Artificial Sequence: Synthetic peptide
  XENP022514 vlCDR3
QQGNTLPYT

SEQ ID NO: 32838 - protein, 447 aa, Artificial Sequence; identical to SEQ ID NO: 17235
  Description of Artificial Sequence: Synthetic polypeptide
  XENP022515 2A11_H1_L2.113-one-arm Fab-Fc Heavy Chain

SEQ ID NO: 32839 - protein, 118 aa, Artificial Sequence; identical to SEQ ID NO: 17236
  Description of Artificial Sequence: Synthetic polypeptide
  VH of XENP022515

SEQ ID NO: 32840 - protein, 5 aa, Artificial Sequence
  Description of Artificial Sequence: Synthetic peptide
  XENP022515 vhCDR1
DYYMH

SEQ ID NO: 32841 - protein, 17 aa, Artificial Sequence
  Description of Artificial Sequence: Synthetic peptide
  XENP022515 vhCDR2
WIDPENGDTEYAPKFQG

SEQ ID NO: 32842 - protein, 9 aa, Artificial Sequence
  Description of Artificial Sequence: Synthetic peptide
  XENP022515 vhCDR3
RGVRQALDY

SEQ ID NO: 32843 - protein, 231 aa, Artificial Sequence; identical to SEQ ID NO: 32799
  Description of Artificial Sequence: Synthetic polypeptide
  XENP022515 2A11_H1_L2.113-one-arm Fc only Heavy Chain

SEQ ID NO: 32844 - protein, 214 aa, Artificial Sequence; identical to SEQ ID NO: 22079
  Description of Artificial Sequence: Synthetic polypeptide
  XENP022515 2A11_H1_L2.113-one-arm Light Chain

SEQ ID NO: 32845 - protein, 107 aa, Artificial Sequence; identical to SEQ ID NO: 22080
  Description of Artificial Sequence: Synthetic polypeptide
  VL of XENP022515

SEQ ID NO: 32846 - protein, 11 aa, Artificial Sequence
  Description of Artificial Sequence: Synthetic peptide
  XENP022515 vlCDR1
QASQDIGNYLN

SEQ ID NO: 32847 - protein, 7 aa, Artificial Sequence
  Description of Artificial Sequence: Synthetic peptide
  XENP022515 vlCDR2
FTSYLHS

SEQ ID NO: 32848 - protein, 9 aa, Artificial Sequence
  Description of Artificial Sequence: Synthetic peptide
  XENP022515 vlCDR3
QQGNTLPYT

SEQ ID NO: 32849 - protein, 447 aa, Artificial Sequence; identical to SEQ ID NO: 17235
  Description of Artificial Sequence: Synthetic polypeptide
  XENP022516 2A11_H1L2-one-arm Fab-Fc Heavy Chain

SEQ ID NO: 32850 - protein, 118 aa, Artificial Sequence; identical to SEQ ID NO: 17236
  Description of Artificial Sequence: Synthetic polypeptide
  VH of XENP022516

SEQ ID NO: 32851 - protein, 5 aa, Artificial Sequence
  Description of Artificial Sequence: Synthetic peptide
  XENP022516 vhCDR1
DYYMH

SEQ ID NO: 32852 - protein, 17 aa, Artificial Sequence
  Description of Artificial Sequence: Synthetic peptide
  XENP022516 vhCDR2
WIDPENGDTEYAPKFQG

SEQ ID NO: 32853 - protein, 9 aa, Artificial Sequence
  Description of Artificial Sequence: Synthetic peptide
  XENP022516 vhCDR3
RGVRQALDY

SEQ ID NO: 32854 - protein, 231 aa, Artificial Sequence; identical to SEQ ID NO: 32799
  Description of Artificial Sequence: Synthetic polypeptide
  XENP022516 2A11_H1L2-one-arm Fc only Heavy Chain

SEQ ID NO: 32855 - protein, 214 aa, Artificial Sequence; identical to SEQ ID NO: 17250
  Description of Artificial Sequence: Synthetic polypeptide
  XENP022516 2A11_H1L2-one-arm Light Chain

SEQ ID NO: 32856 - protein, 107 aa, Artificial Sequence; identical to SEQ ID NO: 17251
  Description of Artificial Sequence: Synthetic polypeptide
  VL of XENP022516

SEQ ID NO: 32857 - protein, 11 aa, Artificial Sequence
  Description of Artificial Sequence: Synthetic peptide
  XENP022516 vlCDR1
QASQDIGNYLN

SEQ ID NO: 32858 - protein, 7 aa, Artificial Sequence
  Description of Artificial Sequence: Synthetic peptide
  XENP022516 vlCDR2
YTSRLHS

SEQ ID NO: 32859 - protein, 9 aa, Artificial Sequence
  Description of Artificial Sequence: Synthetic peptide
  XENP022516 vlCDR3
QQGNTLPYT

SEQ ID NO: 32860 - protein, 447 aa, Artificial Sequence; identical to SEQ ID NO: 17235
  Description of Artificial Sequence: Synthetic polypeptide
  XENP022517 2A11_H1_L2.25-one-arm Fab-Fc Heavy Chain

SEQ ID NO: 32861 - protein, 118 aa, Artificial Sequence; identical to SEQ ID NO: 17236
  Description of Artificial Sequence: Synthetic polypeptide
  VH of XENP022517

SEQ ID NO: 32862 - protein, 5 aa, Artificial Sequence
  Description of Artificial Sequence: Synthetic peptide
  XENP022517 vhCDR1
DYYMH

SEQ ID NO: 32863 - protein, 17 aa, Artificial Sequence
  Description of Artificial Sequence: Synthetic peptide
  XENP022517 vhCDR2
WIDPENGDTEYAPKFQG

SEQ ID NO: 32864 - protein, 9 aa, Artificial Sequence
  Description of Artificial Sequence: Synthetic peptide
  XENP022517 vhCDR3
RGVRQALDY

SEQ ID NO: 32865 - protein, 231 aa, Artificial Sequence; identical to SEQ ID NO: 32799
  Description of Artificial Sequence: Synthetic polypeptide
  XENP022517 2A11_H1_L2.25-one-arm Fc only Heavy Chain

SEQ ID NO: 32866 - protein, 214 aa, Artificial Sequence; identical to SEQ ID NO: 22179
  Description of Artificial Sequence: Synthetic polypeptide
  XENP022517 2A11_H1_L2.25-one-arm Light Chain

SEQ ID NO: 32867 - protein, 107 aa, Artificial Sequence; identical to SEQ ID NO: 22180
  Description of Artificial Sequence: Synthetic polypeptide
  VL of XENP022517

SEQ ID NO: 32868 - protein, 11 aa, Artificial Sequence
  Description of Artificial Sequence: Synthetic peptide
  XENP022517 vlCDR1
QASQDIGNHLN

SEQ ID NO: 32869 - protein, 7 aa, Artificial Sequence
  Description of Artificial Sequence: Synthetic peptide
  XENP022517 vlCDR2
YTSRLHS

SEQ ID NO: 32870 - protein, 9 aa, Artificial Sequence
  Description of Artificial Sequence: Synthetic peptide
  XENP022517 vlCDR3
QQGNTLPYT

SEQ ID NO: 32871 - protein, 447 aa, Artificial Sequence; identical to SEQ ID NO: 22064
  Description of Artificial Sequence: Synthetic polypeptide
  XENP022674 2A11_H1.125_L2.126-one-arm Fab-Fc Heavy Chain

SEQ ID NO: 32872 - protein, 118 aa, Artificial Sequence; identical to SEQ ID NO: 22065
  Description of Artificial Sequence: Synthetic polypeptide
  VH of XENP022674

SEQ ID NO: 32873 - protein, 5 aa, Artificial Sequence
  Description of Artificial Sequence: Synthetic peptide
  XENP022674 vhCDR1
HYFMH

SEQ ID NO: 32874 - protein, 17 aa, Artificial Sequence
  Description of Artificial Sequence: Synthetic peptide
  XENP022674 vhCDR2
WIDPYLGDTEYAPKFQG

SEQ ID NO: 32875 - protein, 9 aa, Artificial Sequence
  Description of Artificial Sequence: Synthetic peptide
  XENP022674 vhCDR3
RGVYQALDY

SEQ ID NO: 32876 - protein, 231 aa, Artificial Sequence; identical to SEQ ID NO: 32799
  Description of Artificial Sequence: Synthetic polypeptide
  XENP022674 2A11_H1.125_L2.126-one-arm Fc only Heavy Chain

SEQ ID NO: 32877 - protein, 214 aa, Artificial Sequence; identical to SEQ ID NO: 22259
  Description of Artificial Sequence: Synthetic polypeptide
  XENP022674 2A11_H1.125_L2.126-one-arm Light Chain

SEQ ID NO: 32878 - protein, 107 aa, Artificial Sequence; identical to SEQ ID NO: 22260
  Description of Artificial Sequence: Synthetic polypeptide
  VL of XENP022674

SEQ ID NO: 32879 - protein, 11 aa, Artificial Sequence
  Description of Artificial Sequence: Synthetic peptide
  XENP022674 vlCDR1
QASQDIGNYLN

SEQ ID NO: 32880 - protein, 7 aa, Artificial Sequence
  Description of Artificial Sequence: Synthetic peptide
  XENP022674 vlCDR2
FTSYLHS

SEQ ID NO: 32881 - protein, 9 aa, Artificial Sequence
  Description of Artificial Sequence: Synthetic peptide
  XENP022674 vlCDR3
QEGNTLPYT

SEQ ID NO: 32882 - protein, 447 aa, Artificial Sequence; identical to SEQ ID NO: 22084
  Description of Artificial Sequence: Synthetic polypeptide
  XENP022676 2A11_H1.144_L2.142-one-arm Fab-Fc Heavy Chain

SEQ ID NO: 32883 - protein, 118 aa, Artificial Sequence; identical to SEQ ID NO: 22085
  Description of Artificial Sequence: Synthetic polypeptide
  VH of XENP022676

SEQ ID NO: 32884 - protein, 5 aa, Artificial Sequence
  Description of Artificial Sequence: Synthetic peptide
  XENP022676 vhCDR1
DYFMH

SEQ ID NO: 32885 - protein, 17 aa, Artificial Sequence
  Description of Artificial Sequence: Synthetic peptide
  XENP022676 vhCDR2
WIDPELGDTEYAPKFQG

SEQ ID NO: 32886 - protein, 9 aa, Artificial Sequence
  Description of Artificial Sequence: Synthetic peptide
  XENP022676 vhCDR3
RGVYQALDY

SEQ ID NO: 32887 - protein, 231 aa, Artificial Sequence; identical to SEQ ID NO: 32799
  Description of Artificial Sequence: Synthetic polypeptide
  XENP022676 2A11_H1.144_L2.142-one-arm Fc only Heavy Chain

SEQ ID NO: 32888 - protein, 214 aa, Artificial Sequence; identical to SEQ ID NO: 22279
  Description of Artificial Sequence: Synthetic polypeptide
  XENP022676 2A11_H1.144_L2.142-one-arm Light Chain

SEQ ID NO: 32889 - protein, 107 aa, Artificial Sequence; identical to SEQ ID NO: 22280
  Description of Artificial Sequence: Synthetic polypeptide
  VL of XENP022676

SEQ ID NO: 32890 - protein, 11 aa, Artificial Sequence
  Description of Artificial Sequence: Synthetic peptide
  XENP022676 vlCDR1
QASQDIGNYLN

SEQ ID NO: 32891 - protein, 7 aa, Artificial Sequence
  Description of Artificial Sequence: Synthetic peptide
  XENP022676 vlCDR2
FTSYLHS

SEQ ID NO: 32892 - protein, 9 aa, Artificial Sequence
  Description of Artificial Sequence: Synthetic peptide
  XENP022676 vlCDR3
QQGNTLPYT

SEQ ID NO: 32893 - protein, 450 aa, Artificial Sequence; identical to SEQ ID NO: 22324
  Description of Artificial Sequence: Synthetic polypeptide
  XENP022519 7G8_H3.18_L1.11-one-arm Fab-Fc Heavy Chain

SEQ ID NO: 32894 - protein, 121 aa, Artificial Sequence; identical to SEQ ID NO: 22325
  Description of Artificial Sequence: Synthetic polypeptide
  VH of XENP022519

SEQ ID NO: 32895 - protein, 5 aa, Artificial Sequence
  Description of Artificial Sequence: Synthetic peptide
  XENP022519 vhCDR1
DAWMD

SEQ ID NO: 32896 - protein, 19 aa, Artificial Sequence
  Description of Artificial Sequence: Synthetic peptide
  XENP022519 vhCDR2
EISTKANNHATYYAESVKG

SEQ ID NO: 32897 - protein, 10 aa, Artificial Sequence
  Description of Artificial Sequence: Synthetic peptide
  XENP022519 vhCDR3
LATWDWYFDV

SEQ ID NO: 32898 - protein, 231 aa, Artificial Sequence; identical to SEQ ID NO: 32799
  Description of Artificial Sequence: Synthetic polypeptide
  XENP022519 7G8_H3.18_L1.11-one-arm Fc-only Heavy Chain

SEQ ID NO: 32899 - protein, 218 aa, Artificial Sequence; identical to SEQ ID NO: 22359
  Description of Artificial Sequence: Synthetic polypeptide
  XENP022519 7G8_H3.18_L1.11-one-arm Light Chain

SEQ ID NO: 32900 - protein, 111 aa, Artificial Sequence; identical to SEQ ID NO: 22360
  Description of Artificial Sequence: Synthetic polypeptide
  VL of XENP022519

SEQ ID NO: 32901 - protein, 15 aa, Artificial Sequence
  Description of Artificial Sequence: Synthetic peptide
  XENP022519 vlCDR1
RASQSVDYDGDSYMN

SEQ ID NO: 32902 - protein, 7 aa, Artificial Sequence
  Description of Artificial Sequence: Synthetic peptide
  XENP022519 vlCDR2
AASELES

SEQ ID NO: 32903 - protein, 9 aa, Artificial Sequence
  Description of Artificial Sequence: Synthetic peptide
  XENP022519 vlCDR3
QQSNEDPFT

SEQ ID NO: 32904 - protein, 450 aa, Artificial Sequence; identical to SEQ ID NO: 22424
  Description of Artificial Sequence: Synthetic polypeptide
  XENP022520 7G8_H3.28_L1.13-one-arm Fab-Fc Heavy Chain

SEQ ID NO: 32905 - protein, 121 aa, Artificial Sequence; identical to SEQ ID NO: 22425
  Description of Artificial Sequence: Synthetic polypeptide
  VH of XENP022520

SEQ ID NO: 32906 - protein, 5 aa, Artificial Sequence
  Description of Artificial Sequence: Synthetic peptide
  XENP022520 vhCDR1
DAWMD

SEQ ID NO: 32907 - protein, 19 aa, Artificial Sequence
  Description of Artificial Sequence: Synthetic peptide
  XENP022520 vhCDR2
EISTKAYNHATYYAESVKG

SEQ ID NO: 32908 - protein, 10 aa, Artificial Sequence
  Description of Artificial Sequence: Synthetic peptide
  XENP022520 vhCDR3
LATWDWYFDV

SEQ ID NO: 32909 - protein, 231 aa, Artificial Sequence; identical to SEQ ID NO: 32799
  Description of Artificial Sequence: Synthetic polypeptide
  XENP022520 7G8_H3.28_L1.13-one-arm Fc-only Heavy Chain

SEQ ID NO: 32910 - protein, 218 aa, Artificial Sequence; identical to SEQ ID NO: 22419
  Description of Artificial Sequence: Synthetic polypeptide
  XENP022520 7G8_H3.28_L1.13-one-arm Light Chain

SEQ ID NO: 32911 - protein, 111 aa, Artificial Sequence; identical to SEQ ID NO: 22420
  Description of Artificial Sequence: Synthetic polypeptide
  VL of XENP022520

SEQ ID NO: 32912 - protein, 15 aa, Artificial Sequence
  Description of Artificial Sequence: Synthetic peptide
  XENP022520 vlCDR1
RASQSVDHDGDSYMN

SEQ ID NO: 32913 - protein, 7 aa, Artificial Sequence
  Description of Artificial Sequence: Synthetic peptide
  XENP022520 vlCDR2
AASELES

SEQ ID NO: 32914 - protein, 9 aa, Artificial Sequence
  Description of Artificial Sequence: Synthetic peptide
  XENP022520 vlCDR3
QQSNEDPFT

SEQ ID NO: 32915 - protein, 450 aa, Artificial Sequence; identical to SEQ ID NO: 22484
  Description of Artificial Sequence: Synthetic polypeptide
  XENP022560 7G8_H3.30_L1.11-one-arm Fab-Fc Heavy Chain

SEQ ID NO: 32916 - protein, 121 aa, Artificial Sequence; identical to SEQ ID NO: 22485
  Description of Artificial Sequence: Synthetic polypeptide
  VH of XENP022560

SEQ ID NO: 32917 - protein, 5 aa, Artificial Sequence
  Description of Artificial Sequence: Synthetic peptide
  XENP022560 vhCDR1
DAWMS

SEQ ID NO: 32918 - protein, 19 aa, Artificial Sequence
  Description of Artificial Sequence: Synthetic peptide
  XENP022560 vhCDR2
EISTKANNHATYYAESVKG

SEQ ID NO: 32919 - protein, 10 aa, Artificial Sequence
  Description of Artificial Sequence: Synthetic peptide
  XENP022560 vhCDR3
LATWDWYFDV

SEQ ID NO: 32920 - protein, 231 aa, Artificial Sequence; identical to SEQ ID NO: 32799
  Description of Artificial Sequence: Synthetic polypeptide
  XENP022560 7G8_H3.30_L1.11-one-arm Fc-only Heavy Chain

SEQ ID NO: 32921 - protein, 218 aa, Artificial Sequence; identical to SEQ ID NO: 22359
  Description of Artificial Sequence: Synthetic polypeptide
  XENP022560 7G8_H3.30_L1.11-one-arm Light Chain

SEQ ID NO: 32922 - protein, 111 aa, Artificial Sequence; identical to SEQ ID NO: 22360
  Description of Artificial Sequence: Synthetic polypeptide
  VL of XENP022560

SEQ ID NO: 32923 - protein, 15 aa, Artificial Sequence
  Description of Artificial Sequence: Synthetic peptide
  XENP022560 vlCDR1
RASQSVDYDGDSYMN

SEQ ID NO: 32924 - protein, 7 aa, Artificial Sequence
  Description of Artificial Sequence: Synthetic peptide
  XENP022560 vlCDR2
AASELES

SEQ ID NO: 32925 - protein, 9 aa, Artificial Sequence
  Description of Artificial Sequence: Synthetic peptide
  XENP022560 vlCDR3
QQSNEDPFT

SEQ ID NO: 32926 - protein, 450 aa, Artificial Sequence; identical to SEQ ID NO: 22504
  Description of Artificial Sequence: Synthetic polypeptide
  XENP022561 7G8_H3.33_L1.11-one-arm Fab-Fc Heavy Chain

SEQ ID NO: 32927 - protein, 121 aa, Artificial Sequence; identical to SEQ ID NO: 22505
  Description of Artificial Sequence: Synthetic polypeptide
  VH of XENP022561

SEQ ID NO: 32928 - protein, 5 aa, Artificial Sequence
  Description of Artificial Sequence: Synthetic peptide
  XENP022561 vhCDR1
DAWMG

SEQ ID NO: 32929 - protein, 19 aa, Artificial Sequence
  Description of Artificial Sequence: Synthetic peptide
  XENP022561 vhCDR2
EISTKANNHATYYAESVKG

SEQ ID NO: 32930 - protein, 10 aa, Artificial Sequence
  Description of Artificial Sequence: Synthetic peptide
  XENP022561 vhCDR3
LATWDWYFDV

SEQ ID NO: 32931 - protein, 231 aa, Artificial Sequence; identical to SEQ ID NO: 32799
  Description of Artificial Sequence: Synthetic polypeptide
  XENP022561 7G8_H3.33_L1.11-one-arm Fc-only Heavy Chain

SEQ ID NO: 32932 - protein, 218 aa, Artificial Sequence; identical to SEQ ID NO: 22359
  Description of Artificial Sequence: Synthetic polypeptide
  XENP022561 7G8_H3.33_L1.11-one-arm Light Chain

SEQ ID NO: 32933 - protein, 111 aa, Artificial Sequence; identical to SEQ ID NO: 22360
  Description of Artificial Sequence: Synthetic polypeptide
  VL of XENP022561

SEQ ID NO: 32934 - protein, 15 aa, Artificial Sequence
  Description of Artificial Sequence: Synthetic peptide
  XENP022561 vlCDR1
RASQSVDYDGDSYMN

SEQ ID NO: 32935 - protein, 7 aa, Artificial Sequence
  Description of Artificial Sequence: Synthetic peptide
  XENP022561 vlCDR2
AASELES

SEQ ID NO: 32936 - protein, 9 aa, Artificial Sequence
  Description of Artificial Sequence: Synthetic peptide
  XENP022561 vlCDR3
QQSNEDPFT

SEQ ID NO: 32937 - protein, 450 aa, Artificial Sequence; identical to SEQ ID NO: 22324
  Description of Artificial Sequence: Synthetic polypeptide
  XENP022562 7G8_H3.18_L1.30-one-arm Fab-Fc Heavy Chain

SEQ ID NO: 32938 - protein, 121 aa, Artificial Sequence; identical to SEQ ID NO: 22325
  Description of Artificial Sequence: Synthetic polypeptide
  VH of XENP022562

SEQ ID NO: 32939 - protein, 5 aa, Artificial Sequence
  Description of Artificial Sequence: Synthetic peptide
  XENP022562 vhCDR1
DAWMD

SEQ ID NO: 32940 - protein, 19 aa, Artificial Sequence
  Description of Artificial Sequence: Synthetic peptide
  XENP022562 vhCDR2
EISTKANNHATYYAESVKG

SEQ ID NO: 32941 - protein, 10 aa, Artificial Sequence
  Description of Artificial Sequence: Synthetic peptide
  XENP022562 vhCDR3
LATWDWYFDV

SEQ ID NO: 32942 - protein, 231 aa, Artificial Sequence; identical to SEQ ID NO: 32799
  Description of Artificial Sequence: Synthetic polypeptide
  XENP022562 7G8_H3.18_L1.30_[Anti-LAG-3]_Fab-empty_Fc(216)_Ig G1_PVA_/S267K_pI(-)_Isosteric_A_L368D/K370S-IgG1_ISO(+RR)_C220S /S364K/E357Q Heavy-scFv Chain

SEQ ID NO: 32943 - protein, 218 aa, Artificial Sequence; identical to SEQ ID NO: 22539
  Description of Artificial Sequence: Synthetic polypeptide
  XENP022562 7G8_H3.18_L1.30-one-arm Light Chain

SEQ ID NO: 32944 - protein, 111 aa, Artificial Sequence; identical to SEQ ID NO: 22540
  Description of Artificial Sequence: Synthetic polypeptide
  VL of XENP022562

SEQ ID NO: 32945 - protein, 15 aa, Artificial Sequence
  Description of Artificial Sequence: Synthetic peptide
  XENP022562 vlCDR1
RASQSVDYDGDSYMN

SEQ ID NO: 32946 - protein, 7 aa, Artificial Sequence
  Description of Artificial Sequence: Synthetic peptide
  XENP022562 vlCDR2
AASELES

SEQ ID NO: 32947 - protein, 9 aa, Artificial Sequence
  Description of Artificial Sequence: Synthetic peptide
  XENP022562 vlCDR3
QQSNEDPFT

SEQ ID NO: 32948 - protein, 450 aa, Artificial Sequence; identical to SEQ ID NO: 22484
  Description of Artificial Sequence: Synthetic polypeptide
  XENP022563 7G8_H3.30_L1.30-one-arm Fab-Fc Heavy Chain

SEQ ID NO: 32949 - protein, 121 aa, Artificial Sequence; identical to SEQ ID NO: 22485
  Description of Artificial Sequence: Synthetic polypeptide
  VH of XENP022563

SEQ ID NO: 32950 - protein, 5 aa, Artificial Sequence
  Description of Artificial Sequence: Synthetic peptide
  XENP022563 vhCDR1
DAWMS

SEQ ID NO: 32951 - protein, 19 aa, Artificial Sequence
  Description of Artificial Sequence: Synthetic peptide
  XENP022563 vhCDR2
EISTKANNHATYYAESVKG

SEQ ID NO: 32952 - protein, 10 aa, Artificial Sequence
  Description of Artificial Sequence: Synthetic peptide
  XENP022563 vhCDR3
LATWDWYFDV

SEQ ID NO: 32953 - protein, 231 aa, Artificial Sequence; identical to SEQ ID NO: 32799
  Description of Artificial Sequence: Synthetic polypeptide
  XENP022563 7G8_H3.30_L1.30-one-arm Fc-only Heavy Chain

SEQ ID NO: 32954 - protein, 218 aa, Artificial Sequence; identical to SEQ ID NO: 22539
  Description of Artificial Sequence: Synthetic polypeptide
  XENP022563 7G8_H3.30_L1.30-one-arm Light Chain

SEQ ID NO: 32955 - protein, 111 aa, Artificial Sequence; identical to SEQ ID NO: 22540
  Description of Artificial Sequence: Synthetic polypeptide
  VL of XENP022563

SEQ ID NO: 32956 - protein, 15 aa, Artificial Sequence
  Description of Artificial Sequence: Synthetic peptide
  XENP022563 vlCDR1
RASQSVDYDGDSYMN

SEQ ID NO: 32957 - protein, 7 aa, Artificial Sequence
  Description of Artificial Sequence: Synthetic peptide
  XENP022563 vlCDR2
AASELES

SEQ ID NO: 32958 - protein, 9 aa, Artificial Sequence
  Description of Artificial Sequence: Synthetic peptide
  XENP022563 vlCDR3
QQSNEDPFT

SEQ ID NO: 32959 - protein, 450 aa, Artificial Sequence; identical to SEQ ID NO: 22504
  Description of Artificial Sequence: Synthetic polypeptide
  XENP022564 7G8_H3.33_L1.30-one-arm Fab-Fc Heavy Chain

SEQ ID NO: 32960 - protein, 121 aa, Artificial Sequence; identical to SEQ ID NO: 22505
  Description of Artificial Sequence: Synthetic polypeptide
  VH of XENP022564

SEQ ID NO: 32961 - protein, 5 aa, Artificial Sequence
  Description of Artificial Sequence: Synthetic peptide
  XENP022564 vhCDR1
DAWMG

SEQ ID NO: 32962 - protein, 19 aa, Artificial Sequence
  Description of Artificial Sequence: Synthetic peptide
  XENP022564 vhCDR2
EISTKANNHATYYAESVKG

SEQ ID NO: 32963 - protein, 10 aa, Artificial Sequence
  Description of Artificial Sequence: Synthetic peptide
  XENP022564 vhCDR3
LATWDWYFDV

SEQ ID NO: 32964 - protein, 231 aa, Artificial Sequence; identical to SEQ ID NO: 32799
  Description of Artificial Sequence: Synthetic polypeptide
  XENP022564 7G8_H3.33_L1.30-one-arm Fc-only Heavy Chain

SEQ ID NO: 32965 - protein, 218 aa, Artificial Sequence; identical to SEQ ID NO: 22539
  Description of Artificial Sequence: Synthetic polypeptide
  XENP022564 7G8_H3.33_L1.30-one-arm Light Chain

SEQ ID NO: 32966 - protein, 111 aa, Artificial Sequence; identical to SEQ ID NO: 22540
  Description of Artificial Sequence: Synthetic polypeptide
  VL of XENP022564

SEQ ID NO: 32967 - protein, 15 aa, Artificial Sequence
  Description of Artificial Sequence: Synthetic peptide
  XENP022564 vlCDR1
RASQSVDYDGDSYMN

SEQ ID NO: 32968 - protein, 7 aa, Artificial Sequence
  Description of Artificial Sequence: Synthetic peptide
  XENP022564 vlCDR2
AASELES

SEQ ID NO: 32969 - protein, 9 aa, Artificial Sequence
  Description of Artificial Sequence: Synthetic peptide
  XENP022564 vlCDR3
QQSNEDPFT

SEQ ID NO: 32970 - protein, 450 aa, Artificial Sequence; identical to SEQ ID NO: 22484
  Description of Artificial Sequence: Synthetic polypeptide
  XENP022606 7G8_H3.30_L1.34-one-arm Fab-Fc Heavy Chain

SEQ ID NO: 32971 - protein, 121 aa, Artificial Sequence; identical to SEQ ID NO: 22485
  Description of Artificial Sequence: Synthetic polypeptide
  VH of XENP022606

SEQ ID NO: 32972 - protein, 5 aa, Artificial Sequence
  Description of Artificial Sequence: Synthetic peptide
  XENP022606 vhCDR1
DAWMS

SEQ ID NO: 32973 - protein, 19 aa, Artificial Sequence
  Description of Artificial Sequence: Synthetic peptide
  XENP022606 vhCDR2
EISTKANNHATYYAESVKG

SEQ ID NO: 32974 - protein, 10 aa, Artificial Sequence
  Description of Artificial Sequence: Synthetic peptide
  XENP022606 vhCDR3
LATWDWYFDV

SEQ ID NO: 32975 - protein, 231 aa, Artificial Sequence; identical to SEQ ID NO: 32799
  Description of Artificial Sequence: Synthetic polypeptide
  XENP022606 7G8_H3.30_L1.34-one-arm Fc-only Heavy Chain

SEQ ID NO: 32976 - protein, 218 aa, Artificial Sequence; identical to SEQ ID NO: 22599
  Description of Artificial Sequence: Synthetic polypeptide
  XENP022606 7G8_H3.30_L1.34-one-arm Light Chain

SEQ ID NO: 32977 - protein, 111 aa, Artificial Sequence; identical to SEQ ID NO: 22600
  Description of Artificial Sequence: Synthetic polypeptide
  VL of XENP022606

SEQ ID NO: 32978 - protein, 15 aa, Artificial Sequence
  Description of Artificial Sequence: Synthetic peptide
  XENP022606 vlCDR1
RASQSVDYDGDSYMN

SEQ ID NO: 32979 - protein, 7 aa, Artificial Sequence
  Description of Artificial Sequence: Synthetic peptide
  XENP022606 vlCDR2
AASELES

SEQ ID NO: 32980 - protein, 9 aa, Artificial Sequence
  Description of Artificial Sequence: Synthetic peptide
  XENP022606 vlCDR3
QQSNEDPFT

SEQ ID NO: 32981 - protein, 450 aa, Artificial Sequence; identical to SEQ ID NO: 22484
  Description of Artificial Sequence: Synthetic polypeptide
  XENP022607 7G8_H3.30_L1.36-one-arm Fab-Fc Heavy Chain

SEQ ID NO: 32982 - protein, 121 aa, Artificial Sequence; identical to SEQ ID NO: 22485
  Description of Artificial Sequence: Synthetic polypeptide
  VH of XENP022607

SEQ ID NO: 32983 - protein, 5 aa, Artificial Sequence
  Description of Artificial Sequence: Synthetic peptide
  XENP022607 vhCDR1
DAWMS

SEQ ID NO: 32984 - protein, 19 aa, Artificial Sequence
  Description of Artificial Sequence: Synthetic peptide
  XENP022607 vhCDR2
EISTKANNHATYYAESVKG

SEQ ID NO: 32985 - protein, 10 aa, Artificial Sequence
  Description of Artificial Sequence: Synthetic peptide
  XENP022607 vhCDR3
LATWDWYFDV

SEQ ID NO: 32986 - protein, 231 aa, Artificial Sequence; identical to SEQ ID NO: 32799
  Description of Artificial Sequence: Synthetic polypeptide
  XENP022607 7G8_H3.30_L1.36-one-arm Fc-only Heavy Chain

SEQ ID NO: 32987 - protein, 218 aa, Artificial Sequence; identical to SEQ ID NO: 22619
  Description of Artificial Sequence: Synthetic polypeptide
  XENP022607 7G8_H3.30_L1.36-one-arm Light Chain

SEQ ID NO: 32988 - protein, 111 aa, Artificial Sequence; identical to SEQ ID NO: 22620
  Description of Artificial Sequence: Synthetic polypeptide
  VL of XENP022607

SEQ ID NO: 32989 - protein, 15 aa, Artificial Sequence
  Description of Artificial Sequence: Synthetic peptide
  XENP022607 vlCDR1
RASQSVDHDGDSYMN

SEQ ID NO: 32990 - protein, 7 aa, Artificial Sequence
  Description of Artificial Sequence: Synthetic peptide
  XENP022607 vlCDR2
AASELES

SEQ ID NO: 32991 - protein, 9 aa, Artificial Sequence
  Description of Artificial Sequence: Synthetic peptide
  XENP022607 vlCDR3
QQSNEDPFT

SEQ ID NO: 32992 - protein, 450 aa, Artificial Sequence; identical to SEQ ID NO: 22304
  Description of Artificial Sequence: Synthetic polypeptide
  XENP022608 7G8_H3L1-one-arm Fab-Fc Heavy Chain

SEQ ID NO: 32993 - protein, 121 aa, Artificial Sequence; identical to SEQ ID NO: 17806
  Description of Artificial Sequence: Synthetic polypeptide
  VH of XENP022608

SEQ ID NO: 32994 - protein, 5 aa, Artificial Sequence
  Description of Artificial Sequence: Synthetic peptide
  XENP022608 vhCDR1
DAWMD

SEQ ID NO: 32995 - protein, 19 aa, Artificial Sequence
  Description of Artificial Sequence: Synthetic peptide
  XENP022608 vhCDR2
EIRTKANNHATYYAESVKG

SEQ ID NO: 32996 - protein, 10 aa, Artificial Sequence
  Description of Artificial Sequence: Synthetic peptide
  XENP022608 vhCDR3
LANWDWYFDV

SEQ ID NO: 32997 - protein, 231 aa, Artificial Sequence; identical to SEQ ID NO: 32799
  Description of Artificial Sequence: Synthetic polypeptide
  XENP022608 7G8_H3L1-one-arm Fc-only Heavy Chain

SEQ ID NO: 32998 - protein, 218 aa, Artificial Sequence; identical to SEQ ID NO: 17600
  Description of Artificial Sequence: Synthetic polypeptide
  XENP022608 7G8_H3L1-one-arm Light Chain

SEQ ID NO: 32999 - protein, 111 aa, Artificial Sequence; identical to SEQ ID NO: 17601
  Description of Artificial Sequence: Synthetic polypeptide
  VL of XENP022608

SEQ ID NO: 33000 - protein, 15 aa, Artificial Sequence
  Description of Artificial Sequence: Synthetic peptide
  XENP022608 vlCDR1
RASQSVDYDGDSYMN

SEQ ID NO: 33001 - protein, 7 aa, Artificial Sequence
  Description of Artificial Sequence: Synthetic peptide
  XENP022608 vlCDR2
AASNLES

SEQ ID NO: 33002 - protein, 9 aa, Artificial Sequence
  Description of Artificial Sequence: Synthetic peptide
  XENP022608 vlCDR3
QQSNEDPFT

SEQ ID NO: 33003 - protein, 222 aa, Artificial Sequence
  Description of Artificial Sequence: Synthetic polypeptide
  XENP022721 1C11_H1L3_Fab Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33004 - protein, 117 aa, Artificial Sequence
  Description of Artificial Sequence: Synthetic polypeptide
  VH of XENP022721
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSS

SEQ ID NO: 33005 - protein, 5 aa, Artificial Sequence
  Description of Artificial Sequence: Synthetic peptide
  XENP022721 vhCDR1
HYGMN

SEQ ID NO: 33006 - protein, 17 aa, Artificial Sequence
  Description of Artificial Sequence: Synthetic peptide
  XENP022721 vhCDR2
WINTYTGEPTYADKFQG

SEQ ID NO: 33007 - protein, 8 aa, Artificial Sequence
  Description of Artificial Sequence: Synthetic peptide
  XENP022721 vhCDR3
DYYGSSPY

SEQ ID NO: 33008 - protein, 219 aa, Artificial Sequence
  Description of Artificial Sequence: Synthetic polypeptide
  XENP022721 1C11_H1L3_Fab Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33009 - protein, 112 aa, Artificial Sequence
  Description of Artificial Sequence: Synthetic polypeptide
  VL of XENP022721
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 33010 - protein, 16 aa, Artificial Sequence
  Description of Artificial Sequence: Synthetic peptide
  XENP022721 vlCDR1
KSSQSIVHSNGNTYLE

SEQ ID NO: 33011 - protein, 7 aa, Artificial Sequence
  Description of Artificial Sequence: Synthetic peptide
  XENP022721 vlCDR2
KVSNRFS

SEQ ID NO: 33012 - protein, 9 aa, Artificial Sequence
  Description of Artificial Sequence: Synthetic peptide
  XENP022721 vlCDR3
FQGSHVPNT

SEQ ID NO: 33013 - protein, 222 aa, Artificial Sequence
  Description of Artificial Sequence: Synthetic polypeptide
  XENP022722 1C11_H2L1_Fab Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33014 - protein, 117 aa, Artificial Sequence
  Description of Artificial Sequence: Synthetic polypeptide
  VH of XENP022722
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSS

SEQ ID NO: 33015 - protein, 5 aa, Artificial Sequence
  Description of Artificial Sequence: Synthetic peptide
  XENP022722 vhCDR1
HYGMN

SEQ ID NO: 33016 - protein, 17 aa, Artificial Sequence
  Description of Artificial Sequence: Synthetic peptide
  XENP022722 vhCDR2
WINTYTGEPTYADSVKG

SEQ ID NO: 33017 - protein, 8 aa, Artificial Sequence
  Description of Artificial Sequence: Synthetic peptide
  XENP022722 vhCDR3
DYYGSSPY

SEQ ID NO: 33018 - protein, 219 aa, Artificial Sequence
  Description of Artificial Sequence: Synthetic polypeptide
  XENP022722 1C11_H2L1_Fab Light Chain
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33019 - protein, 112 aa, Artificial Sequence
  Description of Artificial Sequence: Synthetic polypeptide
  VL of XENP022722
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIK

SEQ ID NO: 33020 - protein, 16 aa, Artificial Sequence
  Description of Artificial Sequence: Synthetic peptide
  XENP022722 vlCDR1
RSSQSIVHSNGNTYLE

SEQ ID NO: 33021 - protein, 7 aa, Artificial Sequence
  Description of Artificial Sequence: Synthetic peptide
  XENP022722 vlCDR2
KVSNRFS

SEQ ID NO: 33022 - protein, 9 aa, Artificial Sequence
  Description of Artificial Sequence: Synthetic peptide
  XENP022722 vlCDR3
FQGSHVPNT

SEQ ID NO: 33023 - protein, 222 aa, Artificial Sequence; identical to SEQ ID NO: 33013
  Description of Artificial Sequence: Synthetic polypeptide
  XENP022723 1C11_H2L2_Fab Heavy Chain

SEQ ID NO: 33024 - protein, 117 aa, Artificial Sequence; identical to SEQ ID NO: 33014
  Description of Artificial Sequence: Synthetic polypeptide
  VH of XENP022723

SEQ ID NO: 33025 - protein, 5 aa, Artificial Sequence
  Description of Artificial Sequence: Synthetic peptide
  XENP022723 vhCDR1
HYGMN

SEQ ID NO: 33026 - protein, 17 aa, Artificial Sequence
  Description of Artificial Sequence: Synthetic peptide
  XENP022723 vhCDR2
WINTYTGEPTYADSVKG

SEQ ID NO: 33027 - protein, 8 aa, Artificial Sequence
  Description of Artificial Sequence: Synthetic peptide
  XENP022723 vhCDR3
DYYGSSPY

SEQ ID NO: 33028 - protein, 219 aa, Artificial Sequence
  Description of Artificial Sequence: Synthetic polypeptide
  XENP022723 1C11_H2L2_Fab Light Chain
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33029 - protein, 112 aa, Artificial Sequence
  Description of Artificial Sequence: Synthetic polypeptide
  VL of XENP022723
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIK

SEQ ID NO: 33030 - protein, 16 aa, Artificial Sequence
  Description of Artificial Sequence: Synthetic peptide
  XENP022723 vlCDR1
RSSQSIVHSNGNTYLE

SEQ ID NO: 33031 - protein, 7 aa, Artificial Sequence
  Description of Artificial Sequence: Synthetic peptide
  XENP022723 vlCDR2
KVSNRFS

SEQ ID NO: 33032 - protein, 9 aa, Artificial Sequence
  Description of Artificial Sequence: Synthetic peptide
  XENP022723 vlCDR3
FQGSHVPNT

SEQ ID NO: 33033 - protein, 222 aa, Artificial Sequence
  Description of Artificial Sequence: Synthetic polypeptide
  XENP022724 1C11_H3L3_Fab Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33034 - protein, 117 aa, Artificial Sequence
  Description of Artificial Sequence: Synthetic polypeptide
  VH of XENP022724
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33035 - protein, 5 aa, Artificial Sequence
  Description of Artificial Sequence: Synthetic peptide
  XENP022724 vhCDR1
HYGMN

SEQ ID NO: 33036 - protein, 17 aa, Artificial Sequence
  Description of Artificial Sequence: Synthetic peptide
  XENP022724 vhCDR2
WINTYTGEPTYADGFTG

SEQ ID NO: 33037 - protein, 8 aa, Artificial Sequence
  Description of Artificial Sequence: Synthetic peptide
  XENP022724 vhCDR3
DYYGSSPY

SEQ ID NO: 33038 - protein, 219 aa, Artificial Sequence; identical to SEQ ID NO: 33008
  Description of Artificial Sequence: Synthetic polypeptide
  XENP022724 1C11_H3L3_Fab Light Chain

SEQ ID NO: 33039 - protein, 112 aa, Artificial Sequence; identical to SEQ ID NO: 33009
  Description of Artificial Sequence: Synthetic polypeptide
  VL of XENP022724

SEQ ID NO: 33040 - protein, 16 aa, Artificial Sequence
  Description of Artificial Sequence: Synthetic peptide
  XENP022724 vlCDR1
KSSQSIVHSNGNTYLE

SEQ ID NO: 33041 - protein, 7 aa, Artificial Sequence
  Description of Artificial Sequence: Synthetic peptide
  XENP022724 vlCDR2
KVSNRFS

SEQ ID NO: 33042 - protein, 9 aa, Artificial Sequence
  Description of Artificial Sequence: Synthetic peptide
  XENP022724 vlCDR3
FQGSHVPNT

SEQ ID NO: 33043 - protein, 222 aa, Artificial Sequence
  Description of Artificial Sequence: Synthetic polypeptide
  XENP022725 1C11_H0L0_Fab Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 33044 - protein, 117 aa, Artificial Sequence
  Description of Artificial Sequence: Synthetic polypeptide
  VH of XENP022725
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 33045 - protein, 5 aa, Artificial Sequence
  Description of Artificial Sequence: Synthetic peptide
  XENP022725 vhCDR1
HYGMN

SEQ ID NO: 33046 - protein, 17 aa, Artificial Sequence
  Description of Artificial Sequence: Synthetic peptide
  XENP022725 vhCDR2
WINTYTGEPTYADDFKG

SEQ ID NO: 33047 - protein, 8 aa, Artificial Sequence
  Description of Artificial Sequence: Synthetic peptide
  XENP022725 vhCDR3
DYYGSSPY

SEQ ID NO: 33048 - protein, 219 aa, Artificial Sequence
  Description of Artificial Sequence: Synthetic polypeptide
  XENP022725 1C11_H0L0_Fab Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33049 - protein, 112 aa, Artificial Sequence
  Description of Artificial Sequence: Synthetic polypeptide
  VL of XENP022725
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 33050 - protein, 16 aa, Artificial Sequence
  Description of Artificial Sequence: Synthetic peptide
  XENP022725 vlCDR1
RSSQSIVHSNGNTYLE

SEQ ID NO: 33051 - protein, 7 aa, Artificial Sequence
  Description of Artificial Sequence: Synthetic peptide
  XENP022725 vlCDR2
KVSNRFS

SEQ ID NO: 33052 - protein, 9 aa, Artificial Sequence
  Description of Artificial Sequence: Synthetic peptide
  XENP022725 vlCDR3
FQGSHVPNT

SEQ ID NO: 33053 - protein, 222 aa, Artificial Sequence; identical to SEQ ID NO: 33033
  Description of Artificial Sequence: Synthetic polypeptide
  XENP022991 1C11_H3L1_Fab Heavy Chain

SEQ ID NO: 33054 - protein, 117 aa, Artificial Sequence; identical to SEQ ID NO: 33034
  Description of Artificial Sequence: Synthetic polypeptide
  VH of XENP022991

SEQ ID NO: 33055 - protein, 5 aa, Artificial Sequence
  Description of Artificial Sequence: Synthetic peptide
  XENP022991 vhCDR1
HYGMN

SEQ ID NO: 33056 - protein, 17 aa, Artificial Sequence
  Description of Artificial Sequence: Synthetic peptide
  XENP022991 vhCDR2
WINTYTGEPTYADGFTG

SEQ ID NO: 33057 - protein, 8 aa, Artificial Sequence
  Description of Artificial Sequence: Synthetic peptide
  XENP022991 vhCDR3
DYYGSSPY

SEQ ID NO: 33058 - protein, 219 aa, Artificial Sequence; identical to SEQ ID NO: 33018
  Description of Artificial Sequence: Synthetic polypeptide
  XENP022991 1C11_H3L1_Fab Light Chain

SEQ ID NO: 33059 - protein, 112 aa, Artificial Sequence; identical to SEQ ID NO: 33019
  Description of Artificial Sequence: Synthetic polypeptide
  VL of XENP022991

SEQ ID NO: 33060 - protein, 16 aa, Artificial Sequence
  Description of Artificial Sequence: Synthetic peptide
  XENP022991 vlCDR1
RSSQSIVHSNGNTYLE

SEQ ID NO: 33061 - protein, 7 aa, Artificial Sequence
  Description of Artificial Sequence: Synthetic peptide
  XENP022991 vlCDR2
KVSNRFS

SEQ ID NO: 33062 - protein, 9 aa, Artificial Sequence
  Description of Artificial Sequence: Synthetic peptide
  XENP022991 vlCDR3
FQGSHVPNT

SEQ ID NO: 33063 - protein, 222 aa, Artificial Sequence; identical to SEQ ID NO: 33033
  Description of Artificial Sequence: Synthetic polypeptide
  XENP022992 1C11_H3L2_Fab Heavy Chain

SEQ ID NO: 33064 - protein, 117 aa, Artificial Sequence; identical to SEQ ID NO: 33034
  Description of Artificial Sequence: Synthetic polypeptide
  VH of XENP022992

SEQ ID NO: 33065 - protein, 5 aa, Artificial Sequence
  Description of Artificial Sequence: Synthetic peptide
  XENP022992 vhCDR1
HYGMN

SEQ ID NO: 33066 - protein, 17 aa, Artificial Sequence
  Description of Artificial Sequence: Synthetic peptide
  XENP022992 vhCDR2
WINTYTGEPTYADGFTG

SEQ ID NO: 33067 - protein, 8 aa, Artificial Sequence
  Description of Artificial Sequence: Synthetic peptide
  XENP022992 vhCDR3
DYYGSSPY

SEQ ID NO: 33068 - protein, 219 aa, Artificial Sequence; identical to SEQ ID NO: 33028
  Description of Artificial Sequence: Synthetic polypeptide
  XENP022992 1C11_H3L2_Fab Light Chain

SEQ ID NO: 33069 - protein, 112 aa, Artificial Sequence; identical to SEQ ID NO: 33029
  Description of Artificial Sequence: Synthetic polypeptide
  VL of XENP022992

SEQ ID NO: 33070 - protein, 16 aa, Artificial Sequence
  Description of Artificial Sequence: Synthetic peptide
  XENP022992 vlCDR1
RSSQSIVHSNGNTYLE

SEQ ID NO: 33071 - protein, 7 aa, Artificial Sequence
  Description of Artificial Sequence: Synthetic peptide
  XENP022992 vlCDR2
KVSNRFS

SEQ ID NO: 33072 - protein, 9 aa, Artificial Sequence
  Description of Artificial Sequence: Synthetic peptide
  XENP022992 vlCDR3
FQGSHVPNT

SEQ ID NO: 33073 - protein, 251 aa, Artificial Sequence
  Description of Artificial Sequence: Synthetic polypeptide
  XENP023574 1C11_L1H3_scFv
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33074 - protein, 112 aa, Artificial Sequence; identical to SEQ ID NO: 33019
  Description of Artificial Sequence: Synthetic polypeptide
  VH of XENP023574

SEQ ID NO: 33075 - protein, 119 aa, Artificial Sequence
  Description of Artificial Sequence: Synthetic polypeptide
  VL of XENP023574
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33076 - protein, 16 aa, Artificial Sequence
  Description of Artificial Sequence: Synthetic peptide
  XENP023574 vhCDR1
RSSQSIVHSNGNTYLE

SEQ ID NO: 33077 - protein, 7 aa, Artificial Sequence
  Description of Artificial Sequence: Synthetic peptide
  XENP023574 vhCDR2
KVSNRFS

SEQ ID NO: 33078 - protein, 9 aa, Artificial Sequence
  Description of Artificial Sequence: Synthetic peptide
  XENP023574 vhCDR3
FQGSHVPNT

SEQ ID NO: 33079 - protein, 5 aa, Artificial Sequence
  Description of Artificial Sequence: Synthetic peptide
  XENP023574 vlCDR1
HYGMN

SEQ ID NO: 33080 - protein, 17 aa, Artificial Sequence
  Description of Artificial Sequence: Synthetic peptide
  XENP023574 vlCDR2
WINTYTGEPTYADGFTG

SEQ ID NO: 33081 - protein, 8 aa, Artificial Sequence
  Description of Artificial Sequence: Synthetic peptide
  XENP023574 vlCDR3
DYYGSSPY

SEQ ID NO: 33082 - protein, 251 aa, Artificial Sequence
  Description of Artificial Sequence: Synthetic polypeptide
  XENP023575 1C11_L2H3_scFv
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33083 - protein, 112 aa, Artificial Sequence; identical to SEQ ID NO: 33029
  Description of Artificial Sequence: Synthetic polypeptide
  VH of XENP023575

SEQ ID NO: 33084 - protein, 119 aa, Artificial Sequence; identical to SEQ ID NO: 33075
  Description of Artificial Sequence: Synthetic polypeptide
  VL of XENP023575

SEQ ID NO: 33085 - protein, 16 aa, Artificial Sequence
  Description of Artificial Sequence: Synthetic peptide
  XENP023575 vhCDR1
RSSQSIVHSNGNTYLE

SEQ ID NO: 33086 - protein, 7 aa, Artificial Sequence
  Description of Artificial Sequence: Synthetic peptide
  XENP023575 vhCDR2
KVSNRFS

SEQ ID NO: 33087 - protein, 9 aa, Artificial Sequence
  Description of Artificial Sequence: Synthetic peptide
  XENP023575 vhCDR3
FQGSHVPNT

SEQ ID NO: 33088 - protein, 5 aa, Artificial Sequence
  Description of Artificial Sequence: Synthetic peptide
  XENP023575 vlCDR1
HYGMN

SEQ ID NO: 33089 - protein, 17 aa, Artificial Sequence
  Description of Artificial Sequence: Synthetic peptide
  XENP023575 vlCDR2
WINTYTGEPTYADGFTG

SEQ ID NO: 33090 - protein, 8 aa, Artificial Sequence
  Description of Artificial Sequence: Synthetic peptide
  XENP023575 vlCDR3
DYYGSSPY

SEQ ID NO: 33091 - protein, 251 aa, Artificial Sequence
  Description of Artificial Sequence: Synthetic polypeptide
  XENP023576 1C11_L3H3_scFv
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGKPGSGKPGSGKPGSGKPGSQIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGS

SEQ ID NO: 33092 - protein, 112 aa, Artificial Sequence; identical to SEQ ID NO: 33009
  Description of Artificial Sequence: Synthetic polypeptide
  VH of XENP023576

SEQ ID NO: 33093 - protein, 119 aa, Artificial Sequence; identical to SEQ ID NO: 33075
  Description of Artificial Sequence: Synthetic polypeptide
  VL of XENP023576

SEQ ID NO: 33094 - protein, 16 aa, Artificial Sequence
  Description of Artificial Sequence: Synthetic peptide
  XENP023576 vhCDR1
KSSQSIVHSNGNTYLE

SEQ ID NO: 33095 - protein, 7 aa, Artificial Sequence
  Description of Artificial Sequence: Synthetic peptide
  XENP023576 vhCDR2
KVSNRFS

SEQ ID NO: 33096 - protein, 9 aa, Artificial Sequence
  Description of Artificial Sequence: Synthetic peptide
  XENP023576 vhCDR3
FQGSHVPNT

SEQ ID NO: 33097 - protein, 5 aa, Artificial Sequence
  Description of Artificial Sequence: Synthetic peptide
  XENP023576 vlCDR1
HYGMN

SEQ ID NO: 33098 - protein, 17 aa, Artificial Sequence
  Description of Artificial Sequence: Synthetic peptide
  XENP023576 vlCDR2
WINTYTGEPTYADGFTG

SEQ ID NO: 33099 - protein, 8 aa, Artificial Sequence
  Description of Artificial Sequence: Synthetic peptide
  XENP023576 vlCDR3
DYYGSSPY

SEQ ID NO: 33100 - protein, 251 aa, Artificial Sequence
  Description of Artificial Sequence: Synthetic polypeptide
  XENP023577 1C11_H3_L3.1_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33101 - protein, 117 aa, Artificial Sequence; identical to SEQ ID NO: 33034
  Description of Artificial Sequence: Synthetic polypeptide
  VH of XENP023577

SEQ ID NO: 33102 - protein, 114 aa, Artificial Sequence
  Description of Artificial Sequence: Synthetic polypeptide
  VL of XENP023577
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33103 - protein, 5 aa, Artificial Sequence
  Description of Artificial Sequence: Synthetic peptide
  XENP023577 vhCDR1
HYGMN

SEQ ID NO: 33104 - protein, 17 aa, Artificial Sequence
  Description of Artificial Sequence: Synthetic peptide
  XENP023577 vhCDR2
WINTYTGEPTYADGFTG

SEQ ID NO: 33105 - protein, 8 aa, Artificial Sequence
  Description of Artificial Sequence: Synthetic peptide
  XENP023577 vhCDR3
DYYGSSPY

SEQ ID NO: 33106 - protein, 16 aa, Artificial Sequence
  Description of Artificial Sequence: Synthetic peptide
  XENP023577 vlCDR1
KSSQSIVHSNGNTYLE

SEQ ID NO: 33107 - protein, 7 aa, Artificial Sequence
  Description of Artificial Sequence: Synthetic peptide
  XENP023577 vlCDR2
KVSNRFS

SEQ ID NO: 33108 - protein, 9 aa, Artificial Sequence
  Description of Artificial Sequence: Synthetic peptide
  XENP023577 vlCDR3
FQGSHVPNT

SEQ ID NO: 33109 - protein, 251 aa, Artificial Sequence
  Description of Artificial Sequence: Synthetic polypeptide
  XENP023578 1C11_H3_L3.2_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33110 - protein, 117 aa, Artificial Sequence; identical to SEQ ID NO: 33034
  Description of Artificial Sequence: Synthetic polypeptide
  VH of XENP023578

SEQ ID NO: 33111 - protein, 114 aa, Artificial Sequence
  Description of Artificial Sequence: Synthetic polypeptide
  VL of XENP023578
DLLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33112 - protein, 5 aa, Artificial Sequence
  Description of Artificial Sequence: Synthetic peptide
  XENP023578 vhCDR1
HYGMN

SEQ ID NO: 33113 - protein, 17 aa, Artificial Sequence
  Description of Artificial Sequence: Synthetic peptide
  XENP023578 vhCDR2
WINTYTGEPTYADGFTG

SEQ ID NO: 33114 - protein, 8 aa, Artificial Sequence
  Description of Artificial Sequence: Synthetic peptide
  XENP023578 vhCDR3
DYYGSSPY

SEQ ID NO: 33115 - protein, 16 aa, Artificial Sequence
  Description of Artificial Sequence: Synthetic peptide
  XENP023578 vlCDR1
KSSQSIVHSNGNTYLE

SEQ ID NO: 33116 - protein, 7 aa, Artificial Sequence
  Description of Artificial Sequence: Synthetic peptide
  XENP023578 vlCDR2
KVSNRFS

SEQ ID NO: 33117 - protein, 9 aa, Artificial Sequence
  Description of Artificial Sequence: Synthetic peptide
  XENP023578 vlCDR3
FQGSHVPNT

SEQ ID NO: 33118 - protein, 251 aa, Artificial Sequence
  Description of Artificial Sequence: Synthetic polypeptide
  XENP023579 1C11_H3_L3.3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33119 - protein, 117 aa, Artificial Sequence; identical to SEQ ID NO: 33034
  Description of Artificial Sequence: Synthetic polypeptide
  VH of XENP023579

SEQ ID NO: 33120 - protein, 114 aa, Artificial Sequence
  Description of Artificial Sequence: Synthetic polypeptide
  VL of XENP023579
DVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33121 - protein, 5 aa, Artificial Sequence
  Description of Artificial Sequence: Synthetic peptide
  XENP023579 vhCDR1
HYGMN

SEQ ID NO: 33122 - protein, 17 aa, Artificial Sequence
  Description of Artificial Sequence: Synthetic peptide
  XENP023579 vhCDR2
WINTYTGEPTYADGFTG

SEQ ID NO: 33123 - protein, 8 aa, Artificial Sequence
  Description of Artificial Sequence: Synthetic peptide
  XENP023579 vhCDR3
DYYGSSPY

SEQ ID NO: 33124 - protein, 16 aa, Artificial Sequence
  Description of Artificial Sequence: Synthetic peptide
  XENP023579 vlCDR1
KSSQSIVHSNGNTYLE

SEQ ID NO: 33125 - protein, 7 aa, Artificial Sequence
  Description of Artificial Sequence: Synthetic peptide
  XENP023579 vlCDR2
KVSNRFS

SEQ ID NO: 33126 - protein, 9 aa, Artificial Sequence
  Description of Artificial Sequence: Synthetic peptide
  XENP023579 vlCDR3
FQGSHVPNT

SEQ ID NO: 33127 - protein, 251 aa, Artificial Sequence
  Description of Artificial Sequence: Synthetic polypeptide
  XENP023580 1C11_H3_L3.4_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33128 - protein, 117 aa, Artificial Sequence; identical to SEQ ID NO: 33034
  Description of Artificial Sequence: Synthetic polypeptide
  VH of XENP023580

SEQ ID NO: 33129 - protein, 114 aa, Artificial Sequence
  Description of Artificial Sequence: Synthetic polypeptide
  VL of XENP023580
DVEMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33130 - protein, 5 aa, Artificial Sequence
  Description of Artificial Sequence: Synthetic peptide
  XENP023580 vhCDR1
HYGMN

SEQ ID NO: 33131 - protein, 17 aa, Artificial Sequence
  Description of Artificial Sequence: Synthetic peptide
  XENP023580 vhCDR2
WINTYTGEPTYADGFTG

SEQ ID NO: 33132 - protein, 8 aa, Artificial Sequence
  Description of Artificial Sequence: Synthetic peptide
  XENP023580 vhCDR3
DYYGSSPY

SEQ ID NO: 33133 - protein, 16 aa, Artificial Sequence
  Description of Artificial Sequence: Synthetic peptide
  XENP023580 vlCDR1
KSSQSIVHSNGNTYLE

SEQ ID NO: 33134 - protein, 7 aa, Artificial Sequence
  Description of Artificial Sequence: Synthetic peptide
  XENP023580 vlCDR2
KVSNRFS

SEQ ID NO: 33135 - protein, 9 aa, Artificial Sequence
  Description of Artificial Sequence: Synthetic peptide
  XENP023580 vlCDR3
FQGSHVPNT

SEQ ID NO: 33136 - protein, 251 aa, Artificial Sequence
  Description of Artificial Sequence: Synthetic polypeptide
  XENP023581 1C11_H3_L3.5_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33137 - protein, 117 aa, Artificial Sequence; identical to SEQ ID NO: 33034
  Description of Artificial Sequence: Synthetic polypeptide
  VH of XENP023581

SEQ ID NO: 33138 - protein, 114 aa, Artificial Sequence
  Description of Artificial Sequence: Synthetic polypeptide
  VL of XENP023581
DVQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33139 - protein, 5 aa, Artificial Sequence
  Description of Artificial Sequence: Synthetic peptide
  XENP023581 vhCDR1
HYGMN

SEQ ID NO: 33140 - protein, 17 aa, Artificial Sequence
  Description of Artificial Sequence: Synthetic peptide
  XENP023581 vhCDR2
WINTYTGEPTYADGFTG

SEQ ID NO: 33141 - protein, 8 aa, Artificial Sequence
  Description of Artificial Sequence: Synthetic peptide
  XENP023581 vhCDR3
DYYGSSPY

SEQ ID NO: 33142 - protein, 16 aa, Artificial Sequence
  Description of Artificial Sequence: Synthetic peptide
  XENP023581 vlCDR1
KSSQSIVHSNGNTYLE

SEQ ID NO: 33143 - protein, 7 aa, Artificial Sequence
  Description of Artificial Sequence: Synthetic peptide
  XENP023581 vlCDR2
KVSNRFS

SEQ ID NO: 33144 - protein, 9 aa, Artificial Sequence
  Description of Artificial Sequence: Synthetic peptide
  XENP023581 vlCDR3
FQGSHVPNT

SEQ ID NO: 33145 - protein, 251 aa, Artificial Sequence
  Description of Artificial Sequence: Synthetic polypeptide
  XENP023582 1C11_H3_L3.6_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33146 - protein, 117 aa, Artificial Sequence; identical to SEQ ID NO: 33034
  Description of Artificial Sequence: Synthetic polypeptide
  VH of XENP023582

SEQ ID NO: 33147 - protein, 114 aa, Artificial Sequence
  Description of Artificial Sequence: Synthetic polypeptide
  VL of XENP023582
DVDMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33148 - protein, 5 aa, Artificial Sequence
  Description of Artificial Sequence: Synthetic peptide
  XENP023582 vhCDR1
HYGMN

SEQ ID NO: 33149 - protein, 17 aa, Artificial Sequence
  Description of Artificial Sequence: Synthetic peptide
  XENP023582 vhCDR2
WINTYTGEPTYADGFTG

SEQ ID NO: 33150 - protein, 8 aa, Artificial Sequence
  Description of Artificial Sequence: Synthetic peptide
  XENP023582 vhCDR3
DYYGSSPY

SEQ ID NO: 33151 - protein, 16 aa, Artificial Sequence
  Description of Artificial Sequence: Synthetic peptide
  XENP023582 vlCDR1
KSSQSIVHSNGNTYLE

SEQ ID NO: 33152 - protein, 7 aa, Artificial Sequence
  Description of Artificial Sequence: Synthetic peptide
  XENP023582 vlCDR2
KVSNRFS

SEQ ID NO: 33153 - protein, 9 aa, Artificial Sequence
  Description of Artificial Sequence: Synthetic peptide
  XENP023582 vlCDR3
FQGSHVPNT

SEQ ID NO: 33154 - protein, 251 aa, Artificial Sequence
  Description of Artificial Sequence: Synthetic polypeptide
  XENP023583 1C11_H3_L3.7_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33155 - protein, 117 aa, Artificial Sequence; identical to SEQ ID NO: 33034
  Description of Artificial Sequence: Synthetic polypeptide
  VH of XENP023583

SEQ ID NO: 33156 - protein, 114 aa, Artificial Sequence
  Description of Artificial Sequence: Synthetic polypeptide
  VL of XENP023583
DIQMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33157 - protein, 5 aa, Artificial Sequence
  Description of Artificial Sequence: Synthetic peptide
  XENP023583 vhCDR1
HYGMN

SEQ ID NO: 33158 - protein, 17 aa, Artificial Sequence
  Description of Artificial Sequence: Synthetic peptide
  XENP023583 vhCDR2
WINTYTGEPTYADGFTG

SEQ ID NO: 33159 - protein, 8 aa, Artificial Sequence
  Description of Artificial Sequence: Synthetic peptide
  XENP023583 vhCDR3
DYYGSSPY

SEQ ID NO: 33160 - protein, 16 aa, Artificial Sequence
  Description of Artificial Sequence: Synthetic peptide
  XENP023583 vlCDR1
KSSQSIVHSNGNTYLE

SEQ ID NO: 33161 - protein, 7 aa, Artificial Sequence
  Description of Artificial Sequence: Synthetic peptide
  XENP023583 vlCDR2
KVSNRFS

SEQ ID NO: 33162 - protein, 9 aa, Artificial Sequence
  Description of Artificial Sequence: Synthetic peptide
  XENP023583 vlCDR3
FQGSHVPNT

SEQ ID NO: 33163 - protein, 251 aa, Artificial Sequence
  Description of Artificial Sequence: Synthetic polypeptide
  XENP023584 1C11_H3_L3.9_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33164 - protein, 117 aa, Artificial Sequence; identical to SEQ ID NO: 33034
  Description of Artificial Sequence: Synthetic polypeptide
  VH of XENP023584

SEQ ID NO: 33165 - protein, 114 aa, Artificial Sequence
  Description of Artificial Sequence: Synthetic polypeptide
  VL of XENP023584
DVLMTQSPKSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33166 - protein, 5 aa, Artificial Sequence
  Description of Artificial Sequence: Synthetic peptide
  XENP023584 vhCDR1
HYGMN

SEQ ID NO: 33167 - protein, 17 aa, Artificial Sequence
  Description of Artificial Sequence: Synthetic peptide
  XENP023584 vhCDR2
WINTYTGEPTYADGFTG

SEQ ID NO: 33168 - protein, 8 aa, Artificial Sequence
  Description of Artificial Sequence: Synthetic peptide
  XENP023584 vhCDR3
DYYGSSPY

SEQ ID NO: 33169 - protein, 16 aa, Artificial Sequence
  Description of Artificial Sequence: Synthetic peptide
  XENP023584 vlCDR1
KSSQSIVHSNGNTYLE

SEQ ID NO: 33170 - protein, 7 aa, Artificial Sequence
  Description of Artificial Sequence: Synthetic peptide
  XENP023584 vlCDR2
KVSNRFS

SEQ ID NO: 33171 - protein, 9 aa, Artificial Sequence
  Description of Artificial Sequence: Synthetic peptide
  XENP023584 vlCDR3
FQGSHVPNT

SEQ ID NO: 33172 - protein, 251 aa, Artificial Sequence
  Description of Artificial Sequence: Synthetic polypeptide
  XENP023585 1C11_H3_L3.10_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33173 - protein, 117 aa, Artificial Sequence; identical to SEQ ID NO: 33034
  Description of Artificial Sequence: Synthetic polypeptide
  VH of XENP023585

SEQ ID NO: 33174 - protein, 114 aa, Artificial Sequence
  Description of Artificial Sequence: Synthetic polypeptide
  VL of XENP023585
DVLMTQSPLSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33175 - protein, 5 aa, Artificial Sequence
  Description of Artificial Sequence: Synthetic peptide
  XENP023585 vhCDR1
HYGMN

SEQ ID NO: 33176 - protein, 17 aa, Artificial Sequence
  Description of Artificial Sequence: Synthetic peptide
  XENP023585 vhCDR2
WINTYTGEPTYADGFTG

SEQ ID NO: 33177 - protein, 8 aa, Artificial Sequence
  Description of Artificial Sequence: Synthetic peptide
  XENP023585 vhCDR3
DYYGSSPY

SEQ ID NO: 33178 - protein, 16 aa, Artificial Sequence
  Description of Artificial Sequence: Synthetic peptide
  XENP023585 vlCDR1
KSSQSIVHSNGNTYLE

SEQ ID NO: 33179 - protein, 7 aa, Artificial Sequence
  Description of Artificial Sequence: Synthetic peptide
  XENP023585 vlCDR2
KVSNRFS

SEQ ID NO: 33180 - protein, 9 aa, Artificial Sequence
  Description of Artificial Sequence: Synthetic peptide
  XENP023585 vlCDR3
FQGSHVPNT

SEQ ID NO: 33181 - protein, 251 aa, Artificial Sequence
  Description of Artificial Sequence: Synthetic polypeptide
  XENP023586 1C11_H3_L3.11_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33182 - protein, 117 aa, Artificial Sequence; identical to SEQ ID NO: 33034
  Description of Artificial Sequence: Synthetic polypeptide
  VH of XENP023586

SEQ ID NO: 33183 - protein, 114 aa, Artificial Sequence
  Description of Artificial Sequence: Synthetic polypeptide
  VL of XENP023586
DVLMTQSPSSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33184 - protein, 5 aa, Artificial Sequence
  Description of Artificial Sequence: Synthetic peptide
  XENP023586 vhCDR1
HYGMN

SEQ ID NO: 33185 - protein, 17 aa, Artificial Sequence
  Description of Artificial Sequence: Synthetic peptide
  XENP023586 vhCDR2
WINTYTGEPTYADGFTG

SEQ ID NO: 33186 - protein, 8 aa, Artificial Sequence
  Description of Artificial Sequence: Synthetic peptide
  XENP023586 vhCDR3
DYYGSSPY

SEQ ID NO: 33187 - protein, 16 aa, Artificial Sequence
  Description of Artificial Sequence: Synthetic peptide
  XENP023586 vlCDR1
KSSQSIVHSNGNTYLE

SEQ ID NO: 33188 - protein, 7 aa, Artificial Sequence
  Description of Artificial Sequence: Synthetic peptide
  XENP023586 vlCDR2
KVSNRFS

SEQ ID NO: 33189 - protein, 9 aa, Artificial Sequence
  Description of Artificial Sequence: Synthetic peptide
  XENP023586 vlCDR3
FQGSHVPNT

SEQ ID NO: 33190 - protein, 251 aa, Artificial Sequence
  Description of Artificial Sequence: Synthetic polypeptide
  XENP023587 1C11_H3_L3.12_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33191 - protein, 117 aa, Artificial Sequence; identical to SEQ ID NO: 33034
  Description of Artificial Sequence: Synthetic polypeptide
  VH of XENP023587

SEQ ID NO: 33192 - protein, 114 aa, Artificial Sequence
  Description of Artificial Sequence: Synthetic polypeptide
  VL of XENP023587
DVLMTQSPGSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33193 - protein, 5 aa, Artificial Sequence
  Description of Artificial Sequence: Synthetic peptide
  XENP023587 vhCDR1
HYGMN

SEQ ID NO: 33194 - protein, 17 aa, Artificial Sequence
  Description of Artificial Sequence: Synthetic peptide
  XENP023587 vhCDR2
WINTYTGEPTYADGFTG

SEQ ID NO: 33195 - protein, 8 aa, Artificial Sequence
  Description of Artificial Sequence: Synthetic peptide
  XENP023587 vhCDR3
DYYGSSPY

SEQ ID NO: 33196 - protein, 16 aa, Artificial Sequence
  Description of Artificial Sequence: Synthetic peptide
  XENP023587 vlCDR1
KSSQSIVHSNGNTYLE

SEQ ID NO: 33197 - protein, 7 aa, Artificial Sequence
  Description of Artificial Sequence: Synthetic peptide
  XENP023587 vlCDR2
KVSNRFS

SEQ ID NO: 33198 - protein, 9 aa, Artificial Sequence
  Description of Artificial Sequence: Synthetic peptide
  XENP023587 vlCDR3
FQGSHVPNT

SEQ ID NO: 33199 - protein, 251 aa, Artificial Sequence
  Description of Artificial Sequence: Synthetic polypeptide
  XENP023588 1C11_H3_L3.14_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33200 - protein, 117 aa, Artificial Sequence; identical to SEQ ID NO: 33034
  Description of Artificial Sequence: Synthetic polypeptide
  VH of XENP023588

SEQ ID NO: 33201 - protein, 114 aa, Artificial Sequence
  Description of Artificial Sequence: Synthetic polypeptide
  VL of XENP023588
DVLMTQSPDSLPVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33202 - protein, 5 aa, Artificial Sequence
  Description of Artificial Sequence: Synthetic peptide
  XENP023588 vhCDR1
HYGMN

SEQ ID NO: 33203 - protein, 17 aa, Artificial Sequence
  Description of Artificial Sequence: Synthetic peptide
  XENP023588 vhCDR2
WINTYTGEPTYADGFTG

SEQ ID NO: 33204 - protein, 8 aa, Artificial Sequence
  Description of Artificial Sequence: Synthetic peptide
  XENP023588 vhCDR3
DYYGSSPY

SEQ ID NO: 33205 - protein, 16 aa, Artificial Sequence
  Description of Artificial Sequence: Synthetic peptide
  XENP023588 vlCDR1
KSSQSIVHSNGNTYLE

SEQ ID NO: 33206 - protein, 7 aa, Artificial Sequence
  Description of Artificial Sequence: Synthetic peptide
  XENP023588 vlCDR2
KVSNRFS

SEQ ID NO: 33207 - protein, 9 aa, Artificial Sequence
  Description of Artificial Sequence: Synthetic peptide
  XENP023588 vlCDR3
FQGSHVPNT

SEQ ID NO: 33208 - protein, 251 aa, Artificial Sequence
  Description of Artificial Sequence: Synthetic polypeptide
  XENP023589 1C11_H3_L3.15_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33209 - protein, 117 aa, Artificial Sequence; identical to SEQ ID NO: 33034
  Description of Artificial Sequence: Synthetic polypeptide
  VH of XENP023589

SEQ ID NO: 33210 - protein, 114 aa, Artificial Sequence
  Description of Artificial Sequence: Synthetic polypeptide
  VL of XENP023589
DVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33211 - protein, 5 aa, Artificial Sequence
  Description of Artificial Sequence: Synthetic peptide
  XENP023589 vhCDR1
HYGMN

SEQ ID NO: 33212 - protein, 17 aa, Artificial Sequence
  Description of Artificial Sequence: Synthetic peptide
  XENP023589 vhCDR2
WINTYTGEPTYADGFTG

SEQ ID NO: 33213 - protein, 8 aa, Artificial Sequence
  Description of Artificial Sequence: Synthetic peptide
  XENP023589 vhCDR3
DYYGSSPY

SEQ ID NO: 33214 - protein, 16 aa, Artificial Sequence
  Description of Artificial Sequence: Synthetic peptide
  XENP023589 vlCDR1
KSSQSIVHSNGNTYLE

SEQ ID NO: 33215 - protein, 7 aa, Artificial Sequence
  Description of Artificial Sequence: Synthetic peptide
  XENP023589 vlCDR2
KVSNRFS

SEQ ID NO: 33216 - protein, 9 aa, Artificial Sequence
  Description of Artificial Sequence: Synthetic peptide
  XENP023589 vlCDR3
FQGSHVPNT

SEQ ID NO: 33217 - protein, 251 aa, Artificial Sequence
  Description of Artificial Sequence: Synthetic polypeptide
  XENP023590 1C11_H3_L3.16_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33218 - protein, 117 aa, Artificial Sequence; identical to SEQ ID NO: 33034
  Description of Artificial Sequence: Synthetic polypeptide
  VH of XENP023590

SEQ ID NO: 33219 - protein, 114 aa, Artificial Sequence
  Description of Artificial Sequence: Synthetic polypeptide
  VL of XENP023590
DVLMTQSPDSLTVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33220 - protein, 5 aa, Artificial Sequence
  Description of Artificial Sequence: Synthetic peptide
  XENP023590 vhCDR1
HYGMN

SEQ ID NO: 33221 - protein, 17 aa, Artificial Sequence
  Description of Artificial Sequence: Synthetic peptide
  XENP023590 vhCDR2
WINTYTGEPTYADGFTG

SEQ ID NO: 33222 - protein, 8 aa, Artificial Sequence
  Description of Artificial Sequence: Synthetic peptide
  XENP023590 vhCDR3
DYYGSSPY

SEQ ID NO: 33223 - protein, 16 aa, Artificial Sequence
  Description of Artificial Sequence: Synthetic peptide
  XENP023590 vlCDR1
KSSQSIVHSNGNTYLE

SEQ ID NO: 33224 - protein, 7 aa, Artificial Sequence
  Description of Artificial Sequence: Synthetic peptide
  XENP023590 vlCDR2
KVSNRFS

SEQ ID NO: 33225 - protein, 9 aa, Artificial Sequence
  Description of Artificial Sequence: Synthetic peptide
  XENP023590 vlCDR3
FQGSHVPNT

SEQ ID NO: 33226 - protein, 251 aa, Artificial Sequence
  Description of Artificial Sequence: Synthetic polypeptide
  XENP023591 1C11_H3_L3.17_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33227 - protein, 117 aa, Artificial Sequence; identical to SEQ ID NO: 33034
  Description of Artificial Sequence: Synthetic polypeptide
  VH of XENP023591

SEQ ID NO: 33228 - protein, 114 aa, Artificial Sequence
  Description of Artificial Sequence: Synthetic polypeptide
  VL of XENP023591
DVLMTQSPDSLSASVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33229 - protein, 5 aa, Artificial Sequence
  Description of Artificial Sequence: Synthetic peptide
  XENP023591 vhCDR1
HYGMN

SEQ ID NO: 33230 - protein, 17 aa, Artificial Sequence
  Description of Artificial Sequence: Synthetic peptide
  XENP023591 vhCDR2
WINTYTGEPTYADGFTG

SEQ ID NO: 33231 - protein, 8 aa, Artificial Sequence
  Description of Artificial Sequence: Synthetic peptide
  XENP023591 vhCDR3
DYYGSSPY

SEQ ID NO: 33232 - protein, 16 aa, Artificial Sequence
  Description of Artificial Sequence: Synthetic peptide
  XENP023591 vlCDR1
KSSQSIVHSNGNTYLE

SEQ ID NO: 33233 - protein, 7 aa, Artificial Sequence
  Description of Artificial Sequence: Synthetic peptide
  XENP023591 vlCDR2
KVSNRFS

SEQ ID NO: 33234 - protein, 9 aa, Artificial Sequence
  Description of Artificial Sequence: Synthetic peptide
  XENP023591 vlCDR3
FQGSHVPNT

SEQ ID NO: 33235 - protein, 251 aa, Artificial Sequence
  Description of Artificial Sequence: Synthetic polypeptide
  XENP023592 1C11_H3_L3.18_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33236 - protein, 117 aa, Artificial Sequence; identical to SEQ ID NO: 33034
  Description of Artificial Sequence: Synthetic polypeptide
  VH of XENP023592

SEQ ID NO: 33237 - protein, 114 aa, Artificial Sequence
  Description of Artificial Sequence: Synthetic polypeptide
  VL of XENP023592
DVLMTQSPDSLSVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33238 - protein, 5 aa, Artificial Sequence
  Description of Artificial Sequence: Synthetic peptide
  XENP023592 vhCDR1
HYGMN

SEQ ID NO: 33239 - protein, 17 aa, Artificial Sequence
  Description of Artificial Sequence: Synthetic peptide
  XENP023592 vhCDR2
WINTYTGEPTYADGFTG

SEQ ID NO: 33240 - protein, 8 aa, Artificial Sequence
  Description of Artificial Sequence: Synthetic peptide
  XENP023592 vhCDR3
DYYGSSPY

SEQ ID NO: 33241 - protein, 16 aa, Artificial Sequence
  Description of Artificial Sequence: Synthetic peptide
  XENP023592 vlCDR1
KSSQSIVHSNGNTYLE

SEQ ID NO: 33242 - protein, 7 aa, Artificial Sequence
  Description of Artificial Sequence: Synthetic peptide
  XENP023592 vlCDR2
KVSNRFS

SEQ ID NO: 33243 - protein, 9 aa, Artificial Sequence
  Description of Artificial Sequence: Synthetic peptide
  XENP023592 vlCDR3
FQGSHVPNT

SEQ ID NO: 33244 - protein, 251 aa, Artificial Sequence
  Description of Artificial Sequence: Synthetic polypeptide
  XENP023593 1C11_H3_L3.19_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33245 - protein, 117 aa, Artificial Sequence; identical to SEQ ID NO: 33034
  Description of Artificial Sequence: Synthetic polypeptide
  VH of XENP023593

SEQ ID NO: 33246 - protein, 114 aa, Artificial Sequence
  Description of Artificial Sequence: Synthetic polypeptide
  VL of XENP023593
DVLMTQSPDSLSLSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33247 - protein, 5 aa, Artificial Sequence
  Description of Artificial Sequence: Synthetic peptide
  XENP023593 vhCDR1
HYGMN

SEQ ID NO: 33248 - protein, 17 aa, Artificial Sequence
  Description of Artificial Sequence: Synthetic peptide
  XENP023593 vhCDR2
WINTYTGEPTYADGFTG

SEQ ID NO: 33249 - protein, 8 aa, Artificial Sequence
  Description of Artificial Sequence: Synthetic peptide
  XENP023593 vhCDR3
DYYGSSPY

SEQ ID NO: 33250 - protein, 16 aa, Artificial Sequence
  Description of Artificial Sequence: Synthetic peptide
  XENP023593 vlCDR1
KSSQSIVHSNGNTYLE

SEQ ID NO: 33251 - protein, 7 aa, Artificial Sequence
  Description of Artificial Sequence: Synthetic peptide
  XENP023593 vlCDR2
KVSNRFS

SEQ ID NO: 33252 - protein, 9 aa, Artificial Sequence
  Description of Artificial Sequence: Synthetic peptide
  XENP023593 vlCDR3
FQGSHVPNT

SEQ ID NO: 33253 - protein, 251 aa, Artificial Sequence
  Description of Artificial Sequence: Synthetic polypeptide
  XENP023594 1C11_H3_L3.20_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33254 - protein, 117 aa, Artificial Sequence; identical to SEQ ID NO: 33034
  Description of Artificial Sequence: Synthetic polypeptide
  VH of XENP023594

SEQ ID NO: 33255 - protein, 114 aa, Artificial Sequence
  Description of Artificial Sequence: Synthetic polypeptide
  VL of XENP023594
DVLMTQSPDSLAVSSGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33256 - protein, 5 aa, Artificial Sequence
  Description of Artificial Sequence: Synthetic peptide
  XENP023594 vhCDR1
HYGMN

SEQ ID NO: 33257 - protein, 17 aa, Artificial Sequence
  Description of Artificial Sequence: Synthetic peptide
  XENP023594 vhCDR2
WINTYTGEPTYADGFTG

SEQ ID NO: 33258 - protein, 8 aa, Artificial Sequence
  Description of Artificial Sequence: Synthetic peptide
  XENP023594 vhCDR3
DYYGSSPY

SEQ ID NO: 33259 - protein, 16 aa, Artificial Sequence
  Description of Artificial Sequence: Synthetic peptide
  XENP023594 vlCDR1
KSSQSIVHSNGNTYLE

SEQ ID NO: 33260 - protein, 7 aa, Artificial Sequence
  Description of Artificial Sequence: Synthetic peptide
  XENP023594 vlCDR2
KVSNRFS

SEQ ID NO: 33261 - protein, 9 aa, Artificial Sequence
  Description of Artificial Sequence: Synthetic peptide
  XENP023594 vlCDR3
FQGSHVPNT

SEQ ID NO: 33262 - protein, 251 aa, Artificial Sequence
  Description of Artificial Sequence: Synthetic polypeptide
  XENP023595 1C11_H3_L3.21_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33263 - protein, 117 aa, Artificial Sequence; identical to SEQ ID NO: 33034
  Description of Artificial Sequence: Synthetic polypeptide
  VH of XENP023595

SEQ ID NO: 33264 - protein, 114 aa, Artificial Sequence
  Description of Artificial Sequence: Synthetic polypeptide
  VL of XENP023595
DVLMTQSPDSLAVSTGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33265 - protein, 5 aa, Artificial Sequence
  Description of Artificial Sequence: Synthetic peptide
  XENP023595 vhCDR1
HYGMN

SEQ ID NO: 33266 - protein, 17 aa, Artificial Sequence
  Description of Artificial Sequence: Synthetic peptide
  XENP023595 vhCDR2
WINTYTGEPTYADGFTG

SEQ ID NO: 33267 - protein, 8 aa, Artificial Sequence
  Description of Artificial Sequence: Synthetic peptide
  XENP023595 vhCDR3
DYYGSSPY

SEQ ID NO: 33268 - protein, 16 aa, Artificial Sequence
  Description of Artificial Sequence: Synthetic peptide
  XENP023595 vlCDR1
KSSQSIVHSNGNTYLE

SEQ ID NO: 33269 - protein, 7 aa, Artificial Sequence
  Description of Artificial Sequence: Synthetic peptide
  XENP023595 vlCDR2
KVSNRFS

SEQ ID NO: 33270 - protein, 9 aa, Artificial Sequence
  Description of Artificial Sequence: Synthetic peptide
  XENP023595 vlCDR3
FQGSHVPNT

SEQ ID NO: 33271 - protein, 251 aa, Artificial Sequence
  Description of Artificial Sequence: Synthetic polypeptide
  XENP023596 1C11_H3_L3.22_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33272 - protein, 117 aa, Artificial Sequence; identical to SEQ ID NO: 33034
  Description of Artificial Sequence: Synthetic polypeptide
  VH of XENP023596

SEQ ID NO: 33273 - protein, 114 aa, Artificial Sequence
  Description of Artificial Sequence: Synthetic polypeptide
  VL of XENP023596
DVLMTQSPDSLAVSLGERITINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33274 - protein, 5 aa, Artificial Sequence
  Description of Artificial Sequence: Synthetic peptide
  XENP023596 vhCDR1
HYGMN

SEQ ID NO: 33275 - protein, 17 aa, Artificial Sequence
  Description of Artificial Sequence: Synthetic peptide
  XENP023596 vhCDR2
WINTYTGEPTYADGFTG

SEQ ID NO: 33276 - protein, 8 aa, Artificial Sequence
  Description of Artificial Sequence: Synthetic peptide
  XENP023596 vhCDR3
DYYGSSPY

SEQ ID NO: 33277 - protein, 16 aa, Artificial Sequence
  Description of Artificial Sequence: Synthetic peptide
  XENP023596 vlCDR1
KSSQSIVHSNGNTYLE

SEQ ID NO: 33278 - protein, 7 aa, Artificial Sequence
  Description of Artificial Sequence: Synthetic peptide
  XENP023596 vlCDR2
KVSNRFS

SEQ ID NO: 33279 - protein, 9 aa, Artificial Sequence
  Description of Artificial Sequence: Synthetic peptide
  XENP023596 vlCDR3
FQGSHVPNT

SEQ ID NO: 33280 - protein, 251 aa, Artificial Sequence
  Description of Artificial Sequence: Synthetic polypeptide
  XENP023601 1C11_H3_L3.23_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33281 - protein, 117 aa, Artificial Sequence; identical to SEQ ID NO: 33034
  Description of Artificial Sequence: Synthetic polypeptide
  VH of XENP023601

SEQ ID NO: 33282 - protein, 114 aa, Artificial Sequence
  Description of Artificial Sequence: Synthetic polypeptide
  VL of XENP023601
DVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33283 - protein, 5 aa, Artificial Sequence
  Description of Artificial Sequence: Synthetic peptide
  XENP023601 vhCDR1
HYGMN

SEQ ID NO: 33284 - protein, 17 aa, Artificial Sequence
  Description of Artificial Sequence: Synthetic peptide
  XENP023601 vhCDR2
WINTYTGEPTYADGFTG

SEQ ID NO: 33285 - protein, 8 aa, Artificial Sequence
  Description of Artificial Sequence: Synthetic peptide
  XENP023601 vhCDR3
DYYGSSPY

SEQ ID NO: 33286 - protein, 16 aa, Artificial Sequence
  Description of Artificial Sequence: Synthetic peptide
  XENP023601 vlCDR1
KSSQSIVHSNGNTYLE

SEQ ID NO: 33287 - protein, 7 aa, Artificial Sequence
  Description of Artificial Sequence: Synthetic peptide
  XENP023601 vlCDR2
KVSNRFS

SEQ ID NO: 33288 - protein, 9 aa, Artificial Sequence
  Description of Artificial Sequence: Synthetic peptide
  XENP023601 vlCDR3
FQGSHVPNT

SEQ ID NO: 33289 - protein, 251 aa, Artificial Sequence
  Description of Artificial Sequence: Synthetic polypeptide
  XENP023602 1C11_H3_L3.25_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33290 - protein, 117 aa, Artificial Sequence; identical to SEQ ID NO: 33034
  Description of Artificial Sequence: Synthetic polypeptide
  VH of XENP023602

SEQ ID NO: 33291 - protein, 114 aa, Artificial Sequence
  Description of Artificial Sequence: Synthetic polypeptide
  VL of XENP023602
DVLMTQSPDSLAVSLGERATISCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33292 - protein, 5 aa, Artificial Sequence
  Description of Artificial Sequence: Synthetic peptide
  XENP023602 vhCDR1
HYGMN

SEQ ID NO: 33293 - protein, 17 aa, Artificial Sequence
  Description of Artificial Sequence: Synthetic peptide
  XENP023602 vhCDR2
WINTYTGEPTYADGFTG

SEQ ID NO: 33294 - protein, 8 aa, Artificial Sequence
  Description of Artificial Sequence: Synthetic peptide
  XENP023602 vhCDR3
DYYGSSPY

SEQ ID NO: 33295 - protein, 16 aa, Artificial Sequence
  Description of Artificial Sequence: Synthetic peptide
  XENP023602 vlCDR1
KSSQSIVHSNGNTYLE

SEQ ID NO: 33296 - protein, 7 aa, Artificial Sequence
  Description of Artificial Sequence: Synthetic peptide
  XENP023602 vlCDR2
KVSNRFS

SEQ ID NO: 33297 - protein, 9 aa, Artificial Sequence
  Description of Artificial Sequence: Synthetic peptide
  XENP023602 vlCDR3
FQGSHVPNT

SEQ ID NO: 33298 - protein, 251 aa, Artificial Sequence
  Description of Artificial Sequence: Synthetic polypeptide
  XENP023603 1C11_H3_L3.26_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33299 - protein, 117 aa, Artificial Sequence; identical to SEQ ID NO: 33034
  Description of Artificial Sequence: Synthetic polypeptide
  VH of XENP023603

SEQ ID NO: 33300 - protein, 114 aa, Artificial Sequence
  Description of Artificial Sequence: Synthetic polypeptide
  VL of XENP023603
DVLMTQSPDSLAVSLGERATITCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33301 - protein, 5 aa, Artificial Sequence
  Description of Artificial Sequence: Synthetic peptide
  XENP023603 vhCDR1
HYGMN

SEQ ID NO: 33302 - protein, 17 aa, Artificial Sequence
  Description of Artificial Sequence: Synthetic peptide
  XENP023603 vhCDR2
WINTYTGEPTYADGFTG

SEQ ID NO: 33303 - protein, 8 aa, Artificial Sequence
  Description of Artificial Sequence: Synthetic peptide
  XENP023603 vhCDR3
DYYGSSPY

SEQ ID NO: 33304 - protein, 16 aa, Artificial Sequence
  Description of Artificial Sequence: Synthetic peptide
  XENP023603 vlCDR1
KSSQSIVHSNGNTYLE

SEQ ID NO: 33305 - protein, 7 aa, Artificial Sequence
  Description of Artificial Sequence: Synthetic peptide
  XENP023603 vlCDR2
KVSNRFS

SEQ ID NO: 33306 - protein, 9 aa, Artificial Sequence
  Description of Artificial Sequence: Synthetic peptide
  XENP023603 vlCDR3
FQGSHVPNT

SEQ ID NO: 33307 - protein, 251 aa, Artificial Sequence
  Description of Artificial Sequence: Synthetic polypeptide
  XENP023604 1C11_H3_L3.27_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33308 - protein, 117 aa, Artificial Sequence; identical to SEQ ID NO: 33034
  Description of Artificial Sequence: Synthetic polypeptide
  VH of XENP023604

SEQ ID NO: 33309 - protein, 114 aa, Artificial Sequence
  Description of Artificial Sequence: Synthetic polypeptide
  VL of XENP023604
DVLMTQSPDSLAVSLGERATINCQSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33310 - protein, 5 aa, Artificial Sequence
  Description of Artificial Sequence: Synthetic peptide
  XENP023604 vhCDR1
HYGMN

SEQ ID NO: 33311 - protein, 17 aa, Artificial Sequence
  Description of Artificial Sequence: Synthetic peptide
  XENP023604 vhCDR2
WINTYTGEPTYADGFTG

SEQ ID NO: 33312 - protein, 8 aa, Artificial Sequence
  Description of Artificial Sequence: Synthetic peptide
  XENP023604 vhCDR3
DYYGSSPY

SEQ ID NO: 33313 - protein, 16 aa, Artificial Sequence
  Description of Artificial Sequence: Synthetic peptide
  XENP023604 vlCDR1
QSSQSIVHSNGNTYLE

SEQ ID NO: 33314 - protein, 7 aa, Artificial Sequence
  Description of Artificial Sequence: Synthetic peptide
  XENP023604 vlCDR2
KVSNRFS

SEQ ID NO: 33315 - protein, 9 aa, Artificial Sequence
  Description of Artificial Sequence: Synthetic peptide
  XENP023604 vlCDR3
FQGSHVPNT

SEQ ID NO: 33316 - protein, 251 aa, Artificial Sequence
  Description of Artificial Sequence: Synthetic polypeptide
  XENP023605 1C11_H3_L3.28_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33317 - protein, 117 aa, Artificial Sequence; identical to SEQ ID NO: 33034
  Description of Artificial Sequence: Synthetic polypeptide
  VH of XENP023605

SEQ ID NO: 33318 - protein, 114 aa, Artificial Sequence
  Description of Artificial Sequence: Synthetic polypeptide
  VL of XENP023605
DVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33319 - protein, 5 aa, Artificial Sequence
  Description of Artificial Sequence: Synthetic peptide
  XENP023605 vhCDR1
HYGMN

SEQ ID NO: 33320 - protein, 17 aa, Artificial Sequence
  Description of Artificial Sequence: Synthetic peptide
  XENP023605 vhCDR2
WINTYTGEPTYADGFTG

SEQ ID NO: 33321 - protein, 8 aa, Artificial Sequence
  Description of Artificial Sequence: Synthetic peptide
  XENP023605 vhCDR3
DYYGSSPY

SEQ ID NO: 33322 - protein, 16 aa, Artificial Sequence
  Description of Artificial Sequence: Synthetic peptide
  XENP023605 vlCDR1
RSSQSIVHSNGNTYLE

SEQ ID NO: 33323 - protein, 7 aa, Artificial Sequence
  Description of Artificial Sequence: Synthetic peptide
  XENP023605 vlCDR2
KVSNRFS

SEQ ID NO: 33324 - protein, 9 aa, Artificial Sequence
  Description of Artificial Sequence: Synthetic peptide
  XENP023605 vlCDR3
FQGSHVPNT

SEQ ID NO: 33325 - protein, 251 aa, Artificial Sequence
  Description of Artificial Sequence: Synthetic polypeptide
  XENP023606 1C11_H3_L3.29_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33326 - protein, 117 aa, Artificial Sequence; identical to SEQ ID NO: 33034
  Description of Artificial Sequence: Synthetic polypeptide
  VH of XENP023606

SEQ ID NO: 33327 - protein, 114 aa, Artificial Sequence
  Description of Artificial Sequence: Synthetic polypeptide
  VL of XENP023606
DVLMTQSPDSLAVSLGERATINCSSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33328 - protein, 5 aa, Artificial Sequence
  Description of Artificial Sequence: Synthetic peptide
  XENP023606 vhCDR1
HYGMN

SEQ ID NO: 33329 - protein, 17 aa, Artificial Sequence
  Description of Artificial Sequence: Synthetic peptide
  XENP023606 vhCDR2
WINTYTGEPTYADGFTG

SEQ ID NO: 33330 - protein, 8 aa, Artificial Sequence
  Description of Artificial Sequence: Synthetic peptide
  XENP023606 vhCDR3
DYYGSSPY

SEQ ID NO: 33331 - protein, 16 aa, Artificial Sequence
  Description of Artificial Sequence: Synthetic peptide
  XENP023606 vlCDR1
SSSQSIVHSNGNTYLE

SEQ ID NO: 33332 - protein, 7 aa, Artificial Sequence
  Description of Artificial Sequence: Synthetic peptide
  XENP023606 vlCDR2
KVSNRFS

SEQ ID NO: 33333 - protein, 9 aa, Artificial Sequence
  Description of Artificial Sequence: Synthetic peptide
  XENP023606 vlCDR3
FQGSHVPNT

SEQ ID NO: 33334 - protein, 251 aa, Artificial Sequence
  Description of Artificial Sequence: Synthetic polypeptide
  XENP023607 1C11_H3_L3.30_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33335 - protein, 117 aa, Artificial Sequence; identical to SEQ ID NO: 33034
  Description of Artificial Sequence: Synthetic polypeptide
  VH of XENP023607

SEQ ID NO: 33336 - protein, 114 aa, Artificial Sequence
  Description of Artificial Sequence: Synthetic polypeptide
  VL of XENP023607
DVLMTQSPDSLAVSLGERATINCTSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33337 - protein, 5 aa, Artificial Sequence
  Description of Artificial Sequence: Synthetic peptide
  XENP023607 vhCDR1
HYGMN

SEQ ID NO: 33338 - protein, 17 aa, Artificial Sequence
  Description of Artificial Sequence: Synthetic peptide
  XENP023607 vhCDR2
WINTYTGEPTYADGFTG

SEQ ID NO: 33339 - protein, 8 aa, Artificial Sequence
  Description of Artificial Sequence: Synthetic peptide
  XENP023607 vhCDR3
DYYGSSPY

SEQ ID NO: 33340 - protein, 16 aa, Artificial Sequence
  Description of Artificial Sequence: Synthetic peptide
  XENP023607 vlCDR1
TSSQSIVHSNGNTYLE

SEQ ID NO: 33341 - protein, 7 aa, Artificial Sequence
  Description of Artificial Sequence: Synthetic peptide
  XENP023607 vlCDR2
KVSNRFS

SEQ ID NO: 33342 - protein, 9 aa, Artificial Sequence
  Description of Artificial Sequence: Synthetic peptide
  XENP023607 vlCDR3
FQGSHVPNT

SEQ ID NO: 33343 - protein, 251 aa, Artificial Sequence
  Description of Artificial Sequence: Synthetic polypeptide
  XENP023608 1C11_H3_L3.31_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33344 - protein, 117 aa, Artificial Sequence; identical to SEQ ID NO: 33034
  Description of Artificial Sequence: Synthetic polypeptide
  VH of XENP023608

SEQ ID NO: 33345 - protein, 114 aa, Artificial Sequence
  Description of Artificial Sequence: Synthetic polypeptide
  VL of XENP023608
DVLMTQSPDSLAVSLGERATINCKTSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33346 - protein, 5 aa, Artificial Sequence
  Description of Artificial Sequence: Synthetic peptide
  XENP023608 vhCDR1
HYGMN

SEQ ID NO: 33347 - protein, 17 aa, Artificial Sequence
  Description of Artificial Sequence: Synthetic peptide
  XENP023608 vhCDR2
WINTYTGEPTYADGFTG

SEQ ID NO: 33348 - protein, 8 aa, Artificial Sequence
  Description of Artificial Sequence: Synthetic peptide
  XENP023608 vhCDR3
DYYGSSPY

SEQ ID NO: 33349 - protein, 16 aa, Artificial Sequence
  Description of Artificial Sequence: Synthetic peptide
  XENP023608 vlCDR1
KTSQSIVHSNGNTYLE

SEQ ID NO: 33350 - protein, 7 aa, Artificial Sequence
  Description of Artificial Sequence: Synthetic peptide
  XENP023608 vlCDR2
KVSNRFS

SEQ ID NO: 33351 - protein, 9 aa, Artificial Sequence
  Description of Artificial Sequence: Synthetic peptide
  XENP023608 vlCDR3
FQGSHVPNT

SEQ ID NO: 33352 - protein, 251 aa, Artificial Sequence
  Description of Artificial Sequence: Synthetic polypeptide
  XENP023609 1C11_H3_L3.32_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33353 - protein, 117 aa, Artificial Sequence; identical to SEQ ID NO: 33034
  Description of Artificial Sequence: Synthetic polypeptide
  VH of XENP023609

SEQ ID NO: 33354 - protein, 114 aa, Artificial Sequence
  Description of Artificial Sequence: Synthetic polypeptide
  VL of XENP023609
DVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33355 - protein, 5 aa, Artificial Sequence
  Description of Artificial Sequence: Synthetic peptide
  XENP023609 vhCDR1
HYGMN

SEQ ID NO: 33356 - protein, 17 aa, Artificial Sequence
  Description of Artificial Sequence: Synthetic peptide
  XENP023609 vhCDR2
WINTYTGEPTYADGFTG

SEQ ID NO: 33357 - protein, 8 aa, Artificial Sequence
  Description of Artificial Sequence: Synthetic peptide
  XENP023609 vhCDR3
DYYGSSPY

SEQ ID NO: 33358 - protein, 16 aa, Artificial Sequence
  Description of Artificial Sequence: Synthetic peptide
  XENP023609 vlCDR1
KASQSIVHSNGNTYLE

SEQ ID NO: 33359 - protein, 7 aa, Artificial Sequence
  Description of Artificial Sequence: Synthetic peptide
  XENP023609 vlCDR2
KVSNRFS

SEQ ID NO: 33360 - protein, 9 aa, Artificial Sequence
  Description of Artificial Sequence: Synthetic peptide
  XENP023609 vlCDR3
FQGSHVPNT

SEQ ID NO: 33361 - protein, 251 aa, Artificial Sequence
  Description of Artificial Sequence: Synthetic polypeptide
  XENP023610 1C11_H3_L3.34_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33362 - protein, 117 aa, Artificial Sequence; identical to SEQ ID NO: 33034
  Description of Artificial Sequence: Synthetic polypeptide
  VH of XENP023610

SEQ ID NO: 33363 - protein, 114 aa, Artificial Sequence
  Description of Artificial Sequence: Synthetic polypeptide
  VL of XENP023610
DVLMTQSPDSLAVSLGERATINCKSSQSVVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33364 - protein, 5 aa, Artificial Sequence
  Description of Artificial Sequence: Synthetic peptide
  XENP023610 vhCDR1
HYGMN

SEQ ID NO: 33365 - protein, 17 aa, Artificial Sequence
  Description of Artificial Sequence: Synthetic peptide
  XENP023610 vhCDR2
WINTYTGEPTYADGFTG

SEQ ID NO: 33366 - protein, 8 aa, Artificial Sequence
  Description of Artificial Sequence: Synthetic peptide
  XENP023610 vhCDR3
DYYGSSPY

SEQ ID NO: 33367 - protein, 16 aa, Artificial Sequence
  Description of Artificial Sequence: Synthetic peptide
  XENP023610 vlCDR1
KSSQSVVHSNGNTYLE

SEQ ID NO: 33368 - protein, 7 aa, Artificial Sequence
  Description of Artificial Sequence: Synthetic peptide
  XENP023610 vlCDR2
KVSNRFS

SEQ ID NO: 33369 - protein, 9 aa, Artificial Sequence
  Description of Artificial Sequence: Synthetic peptide
  XENP023610 vlCDR3
FQGSHVPNT

SEQ ID NO: 33370 - protein, 251 aa, Artificial Sequence
  Description of Artificial Sequence: Synthetic polypeptide
  XENP023611 1C11_H3_L3.35_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33371 - protein, 117 aa, Artificial Sequence; identical to SEQ ID NO: 33034
  Description of Artificial Sequence: Synthetic polypeptide
  VH of XENP023611

SEQ ID NO: 33372 - protein, 114 aa, Artificial Sequence
  Description of Artificial Sequence: Synthetic polypeptide
  VL of XENP023611
DVLMTQSPDSLAVSLGERATINCKSSQSAVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33373 - protein, 5 aa, Artificial Sequence
  Description of Artificial Sequence: Synthetic peptide
  XENP023611 vhCDR1
HYGMN

SEQ ID NO: 33374 - protein, 17 aa, Artificial Sequence
  Description of Artificial Sequence: Synthetic peptide
  XENP023611 vhCDR2
WINTYTGEPTYADGFTG

SEQ ID NO: 33375 - protein, 8 aa, Artificial Sequence
  Description of Artificial Sequence: Synthetic peptide
  XENP023611 vhCDR3
DYYGSSPY

SEQ ID NO: 33376 - protein, 16 aa, Artificial Sequence
  Description of Artificial Sequence: Synthetic peptide
  XENP023611 vlCDR1
KSSQSAVHSNGNTYLE

SEQ ID NO: 33377 - protein, 7 aa, Artificial Sequence
  Description of Artificial Sequence: Synthetic peptide
  XENP023611 vlCDR2
KVSNRFS

SEQ ID NO: 33378 - protein, 9 aa, Artificial Sequence
  Description of Artificial Sequence: Synthetic peptide
  XENP023611 vlCDR3
FQGSHVPNT

SEQ ID NO: 33379 - protein, 251 aa, Artificial Sequence
  Description of Artificial Sequence: Synthetic polypeptide
  XENP023612 1C11_H3_L3.36_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33380 - protein, 117 aa, Artificial Sequence; identical to SEQ ID NO: 33034
  Description of Artificial Sequence: Synthetic polypeptide
  VH of XENP023612

SEQ ID NO: 33381 - protein, 114 aa, Artificial Sequence
  Description of Artificial Sequence: Synthetic polypeptide
  VL of XENP023612
DVLMTQSPDSLAVSLGERATINCKSSQSIVHSSNNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33382 - protein, 5 aa, Artificial Sequence
  Description of Artificial Sequence: Synthetic peptide
  XENP023612 vhCDR1
HYGMN

SEQ ID NO: 33383 - protein, 17 aa, Artificial Sequence
  Description of Artificial Sequence: Synthetic peptide
  XENP023612 vhCDR2
WINTYTGEPTYADGFTG

SEQ ID NO: 33384 - protein, 8 aa, Artificial Sequence
  Description of Artificial Sequence: Synthetic peptide
  XENP023612 vhCDR3
DYYGSSPY

SEQ ID NO: 33385 - protein, 16 aa, Artificial Sequence
  Description of Artificial Sequence: Synthetic peptide
  XENP023612 vlCDR1
KSSQSIVHSSNNTYLE

SEQ ID NO: 33386 - protein, 7 aa, Artificial Sequence
  Description of Artificial Sequence: Synthetic peptide
  XENP023612 vlCDR2
KVSNRFS

SEQ ID NO: 33387 - protein, 9 aa, Artificial Sequence
  Description of Artificial Sequence: Synthetic peptide
  XENP023612 vlCDR3
FQGSHVPNT

SEQ ID NO: 33388 - protein, 251 aa, Artificial Sequence
  Description of Artificial Sequence: Synthetic polypeptide
  XENP023613 1C11_H3_L3.37_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 33389 - protein, 117 aa, Artificial Sequence; identical to SEQ ID NO: 33034
  Description of Artificial Sequence: Synthetic polypeptide
  VH of XENP023613

SEQ ID NO: 33390 - protein, 114 aa, Artificial Sequence
  Description of Artificial Sequence: Synthetic polypeptide
  VL of XENP023613
DVLMTQSPDSLAVSLGERATINCKSSQSIVHSNGNSYLEWYQQKPGQSPKLLIYKVSNRFSGVPDRFSGSGSGTDFTLTISSLQAEDVAVYYCFQGSHVPNTFGGGTKVEIKGS

SEQ ID NO: 33391 - protein, 5 aa, Artificial Sequence
  Description of Artificial Sequence: Synthetic peptide
  XENP023613 vhCDR1
HYGMN

SEQ ID NO: 33392 - protein, 17 aa, Artificial Sequence
  Description of Artificial Sequence: Synthetic peptide
  XENP023613 vhCDR2
WINTYTGEPTYADGFTG

SEQ ID NO: 33393 - protein, 8 aa, Artificial Sequence
  Description of Artificial Sequence: Synthetic peptide
  XENP023613 vhCDR3
DYYGSSPY

SEQ ID NO: 33394 - protein, 16 aa, Artificial Sequence
  Description of Artificial Sequence: Synthetic peptide
  XENP023613 vlCDR1
KSSQSIVHSNGNSYLE

SEQ ID NO: 33395 - protein, 7 aa, Artificial Sequence
  Description of Artificial Sequence: Synthetic peptide
  XENP023613 vlCDR2
KVSNRFS

SEQ ID NO: 33396 - protein, 9 aa, Artificial Sequence
  Description of Artificial Sequence: Synthetic peptide
  XENP023613 vlCDR3
FQGSHVPNT

SEQ ID NO: 33397 - protein, 251 aa, Artificial Sequence
  Description of Artificial Sequence: Synthetic polypeptide
  XENP023614 1C11_H3_L3.38_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 33398 - protein, 117 aa, Artificial Sequence; identical to SEQ ID NO: 33034
  Description of Artificial Sequence: Synthetic polypeptide
  VH of XENP023614

SEQ ID NO: 33399 - protein, 114 aa, Artificial Sequence
  Description of Artificial Sequence: Synthetic polypeptide
  VL of XENP023614
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKGS

SEQ ID NO: 33400 - protein, 5 aa, Artificial Sequence
  Description of Artificial Sequence: Synthetic peptide
  XENP023614 vhCDR1
HYGMN

SEQ ID NO: 33401 - protein, 17 aa, Artificial Sequence
  Description of Artificial Sequence: Synthetic peptide
  XENP023614 vhCDR2
WINTYTGEPTYADGFTG

SEQ ID NO: 33402 - protein, 8 aa, Artificial Sequence
  Description of Artificial Sequence: Synthetic peptide
  XENP023614 vhCDR3
DYYGSSPY

SEQ ID NO: 33403 - protein, 16 aa, Artificial Sequence
  Description of Artificial Sequence: Synthetic peptide
  XENP023614 vlCDR1
KSSQSIVHSNGNNYLE

SEQ ID NO: 33404 - protein, 7 aa, Artificial Sequence
  Description of Artificial Sequence: Synthetic peptide
  XENP023614 vlCDR2
KVSNRFS

SEQ ID NO: 33405 - protein, 9 aa, Artificial Sequence
  Description of Artificial Sequence: Synthetic peptide
  XENP023614 vlCDR3
FQGSHVPNT

SEQ ID NO: 33406 - protein, 251 aa, Artificial Sequence
  Description of Artificial Sequence: Synthetic polypeptide
  XENP023615 1C11_H3_L3.46_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 33407 - protein, 117 aa, Artificial Sequence; identical to SEQ ID NO: 33034
  Description of Artificial Sequence: Synthetic polypeptide
  VH of XENP023615

SEQ ID NO: 33408 - protein, 114 aa, Artificial Sequence
  Description of Artificial Sequence: Synthetic polypeptide
  VL of XENP023615
DVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 33409 - protein, 5 aa, Artificial Sequence
  Description of Artificial Sequence: Synthetic peptide
  XENP023615 vhCDR1
HYGMN

SEQ ID NO: 33410 - protein, 17 aa, Artificial Sequence
  Description of Artificial Sequence: Synthetic peptide
  XENP023615 vhCDR2
WINTYTGEPTYADGFTG

SEQ ID NO: 33411 - protein, 8 aa, Artificial Sequence
  Description of Artificial Sequence: Synthetic peptide
  XENP023615 vhCDR3
DYYGSSPY

SEQ ID NO: 33412 - protein, 16 aa, Artificial Sequence
  Description of Artificial Sequence: Synthetic peptide
  XENP023615 vlCDR1
KSSQSIVHSNGNTYLE

SEQ ID NO: 33413 - protein, 7 aa, Artificial Sequence
  Description of Artificial Sequence: Synthetic peptide
  XENP023615 vlCDR2
KVSNRFS

SEQ ID NO: 33414 - protein, 9 aa, Artificial Sequence
  Description of Artificial Sequence: Synthetic peptide
  XENP023615 vlCDR3
FQGSHVPNT

SEQ ID NO: 33415 - protein, 251 aa, Artificial Sequence
  Description of Artificial Sequence: Synthetic polypeptide
  XENP023616 1C11_H3_L3.47_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 33416 - protein, 117 aa, Artificial Sequence; identical to SEQ ID NO: 33034
  Description of Artificial Sequence: Synthetic polypeptide
  VH of XENP023616

SEQ ID NO: 33417 - protein, 114 aa, Artificial Sequence
  Description of Artificial Sequence: Synthetic polypeptide
  VL of XENP023616
DVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIKGS

SEQ ID NO: 33418 - protein, 5 aa, Artificial Sequence
  Description of Artificial Sequence: Synthetic peptide
  XENP023616 vhCDR1
HYGMN

SEQ ID NO: 33419 - protein, 17 aa, Artificial Sequence
  Description of Artificial Sequence: Synthetic peptide
  XENP023616 vhCDR2
WINTYTGEPTYADGFTG

SEQ ID NO: 33420 - protein, 8 aa, Artificial Sequence
  Description of Artificial Sequence: Synthetic peptide
  XENP023616 vhCDR3
DYYGSSPY

SEQ ID NO: 33421 - protein, 16 aa, Artificial Sequence
  Description of Artificial Sequence: Synthetic peptide
  XENP023616 vlCDR1
KSSQSIVHSNGNTYLE

SEQ ID NO: 33422 - protein, 7 aa, Artificial Sequence
  Description of Artificial Sequence: Synthetic peptide
  XENP023616 vlCDR2
KVSNRFS

SEQ ID NO: 33423 - protein, 9 aa, Artificial Sequence
  Description of Artificial Sequence: Synthetic peptide
  XENP023616 vlCDR3
FQGSHVPNT

SEQ ID NO: 33424 - protein, 251 aa, Artificial Sequence
  Description of Artificial Sequence: Synthetic polypeptide
  XENP023617 1C11_H3_L3.49_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 33425 - protein, 117 aa, Artificial Sequence; identical to SEQ ID NO: 33034
  Description of Artificial Sequence: Synthetic polypeptide
  VH of XENP023617

SEQ ID NO: 33426 - protein, 114 aa, Artificial Sequence
  Description of Artificial Sequence: Synthetic polypeptide
  VL of XENP023617
DVLMTQSPDSLAVSLGERATINCKSSQSIVHSNGNTYLEWYQQKPGQSPKLLIYGVSNRFSGVPDRFSGSGSGTDFTLTISSLQAEDVAVYYCFQGSHVPNTFGGGTKVEIKGS

SEQ ID NO: 33427 - protein, 5 aa, Artificial Sequence
  Description of Artificial Sequence: Synthetic peptide
  XENP023617 vhCDR1
HYGMN

SEQ ID NO: 33428 - protein, 17 aa, Artificial Sequence
  Description of Artificial Sequence: Synthetic peptide
  XENP023617 vhCDR2
WINTYTGEPTYADGFTG

SEQ ID NO: 33429 - protein, 8 aa, Artificial Sequence
  Description of Artificial Sequence: Synthetic peptide
  XENP023617 vhCDR3
DYYGSSPY

SEQ ID NO: 33430 - protein, 16 aa, Artificial Sequence
  Description of Artificial Sequence: Synthetic peptide
  XENP023617 vlCDR1
KSSQSIVHSNGNTYLE

SEQ ID NO: 33431 - protein, 7 aa, Artificial Sequence
  Description of Artificial Sequence: Synthetic peptide
  XENP023617 vlCDR2
GVSNRFS

SEQ ID NO: 33432 - protein, 9 aa, Artificial Sequence
  Description of Artificial Sequence: Synthetic peptide
  XENP023617 vlCDR3
FQGSHVPNT

SEQ ID NO: 33433 - protein, 251 aa, Artificial Sequence
  Description of Artificial Sequence: Synthetic polypeptide
  XENP023618 1C11_H3_L3.50_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 33434 - protein, 117 aa, Artificial Sequence; identical to SEQ ID NO: 33034
  Description of Artificial Sequence: Synthetic polypeptide
  VH of XENP023618

SEQ ID NO: 33435 - protein, 114 aa, Artificial Sequence
  Description of Artificial Sequence: Synthetic polypeptide
  VL of XENP023618
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKGS

SEQ ID NO: 33436 - protein, 5 aa, Artificial Sequence
  Description of Artificial Sequence: Synthetic peptide
  XENP023618 vhCDR1
HYGMN

SEQ ID NO: 33437 - protein, 17 aa, Artificial Sequence
  Description of Artificial Sequence: Synthetic peptide
  XENP023618 vhCDR2
WINTYTGEPTYADGFTG

SEQ ID NO: 33438 - protein, 8 aa, Artificial Sequence
  Description of Artificial Sequence: Synthetic peptide
  XENP023618 vhCDR3
DYYGSSPY

SEQ ID NO: 33439 - protein, 16 aa, Artificial Sequence
  Description of Artificial Sequence: Synthetic peptide
  XENP023618 vlCDR1
KSSQSIVHSNGNTYLE

SEQ ID NO: 33440 - protein, 7 aa, Artificial Sequence
  Description of Artificial Sequence: Synthetic peptide
  XENP023618 vlCDR2
SVSNRFS

SEQ ID NO: 33441 - protein, 9 aa, Artificial Sequence
  Description of Artificial Sequence: Synthetic peptide
  XENP023618 vlCDR3
FQGSHVPNT

SEQ ID NO: 33442 - protein, 251 aa, Artificial Sequence
  Description of Artificial Sequence: Synthetic polypeptide
  XENP023619 1C11_H3_L3.51_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 33443 - protein, 117 aa, Artificial Sequence; identical to SEQ ID NO: 33034
  Description of Artificial Sequence: Synthetic polypeptide
  VH of XENP023619

SEQ ID NO: 33444 - protein, 114 aa, Artificial Sequence
  Description of Artificial Sequence: Synthetic polypeptide
  VL of XENP023619
DVLMTQSPDSLAVSLGERATINCKSSQSIVHSNGNTYLEWYQQKPGQSPKLLIYKASNRFSGVPDRFSGSGSGTDFTLTISSLQAEDVAVYYCFQGSHVPNTFGGGTKVEIKGS

SEQ ID NO: 33445 - protein, 5 aa, Artificial Sequence
  Description of Artificial Sequence: Synthetic peptide
  XENP023619 vhCDR1
HYGMN

SEQ ID NO: 33446 - protein, 17 aa, Artificial Sequence
  Description of Artificial Sequence: Synthetic peptide
  XENP023619 vhCDR2
WINTYTGEPTYADGFTG

SEQ ID NO: 33447 - protein, 8 aa, Artificial Sequence
  Description of Artificial Sequence: Synthetic peptide
  XENP023619 vhCDR3
DYYGSSPY

SEQ ID NO: 33448 - protein, 16 aa, Artificial Sequence
  Description of Artificial Sequence: Synthetic peptide
  XENP023619 vlCDR1
KSSQSIVHSNGNTYLE

SEQ ID NO: 33449 - protein, 7 aa, Artificial Sequence
  Description of Artificial Sequence: Synthetic peptide
  XENP023619 vlCDR2
KASNRFS

SEQ ID NO: 33450 - protein, 9 aa, Artificial Sequence
  Description of Artificial Sequence: Synthetic peptide
  XENP023619 vlCDR3
FQGSHVPNT

SEQ ID NO: 33451 - protein, 251 aa, Artificial Sequence
  Description of Artificial Sequence: Synthetic polypeptide
  XENP023620 1C11_H3_L3.52_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 33452 - protein, 117 aa, Artificial Sequence; identical to SEQ ID NO: 33034
  Description of Artificial Sequence: Synthetic polypeptide
  VH of XENP023620

SEQ ID NO: 33453 - protein, 114 aa, Artificial Sequence
  Description of Artificial Sequence: Synthetic polypeptide
  VL of XENP023620
DVLMTQSPDSLAVSLGERATINCKSSQSIVHSNGNTYLEWYQQKPGQSPKLLIYKTSNRFSGVPDRFSGSGSGTDFTLTISSLQAEDVAVYYCFQGSHVPNTFGGGTKVEIKGS

SEQ ID NO: 33454 - protein, 5 aa, Artificial Sequence
  Description of Artificial Sequence: Synthetic peptide
  XENP023620 vhCDR1
HYGMN

SEQ ID NO: 33455 - protein, 17 aa, Artificial Sequence
  Description of Artificial Sequence: Synthetic peptide
  XENP023620 vhCDR2
WINTYTGEPTYADGFTG

SEQ ID NO: 33456 - protein, 8 aa, Artificial Sequence
  Description of Artificial Sequence: Synthetic peptide
  XENP023620 vhCDR3
DYYGSSPY

SEQ ID NO: 33457 - protein, 16 aa, Artificial Sequence
  Description of Artificial Sequence: Synthetic peptide
  XENP023620 vlCDR1
KSSQSIVHSNGNTYLE

SEQ ID NO: 33458 - protein, 7 aa, Artificial Sequence
  Description of Artificial Sequence: Synthetic peptide
  XENP023620 vlCDR2
KTSNRFS

SEQ ID NO: 33459 - protein, 9 aa, Artificial Sequence
  Description of Artificial Sequence: Synthetic peptide
  XENP023620 vlCDR3
FQGSHVPNT

SEQ ID NO: 33460 - protein, 251 aa, Artificial Sequence
  Description of Artificial Sequence: Synthetic polypeptide
  XENP023621 1C11_H3_L3.53_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 33461 - protein, 117 aa, Artificial Sequence; identical to SEQ ID NO: 33034
  Description of Artificial Sequence: Synthetic polypeptide
  VH of XENP023621

SEQ ID NO: 33462 - protein, 114 aa, Artificial Sequence
  Description of Artificial Sequence: Synthetic polypeptide
  VL of XENP023621
DVLMTQSPDSLAVSLGERATINCKSSQSIVHSNGNTYLEWYQQKPGQSPKLLIYKGSNRFSGVPDRFSGSGSGTDFTLTISSLQAEDVAVYYCFQGSHVPNTFGGGTKVEIKGS

SEQ ID NO: 33463 - protein, 5 aa, Artificial Sequence
  Description of Artificial Sequence: Synthetic peptide
  XENP023621 vhCDR1
HYGMN

SEQ ID NO: 33464 - protein, 17 aa, Artificial Sequence
  Description of Artificial Sequence: Synthetic peptide
  XENP023621 vhCDR2
WINTYTGEPTYADGFTG

SEQ ID NO: 33465 - protein, 8 aa, Artificial Sequence
  Description of Artificial Sequence: Synthetic peptide
  XENP023621 vhCDR3
DYYGSSPY

SEQ ID NO: 33466 - protein, 16 aa, Artificial Sequence
  Description of Artificial Sequence: Synthetic peptide
  XENP023621 vlCDR1
KSSQSIVHSNGNTYLE

SEQ ID NO: 33467 - protein, 7 aa, Artificial Sequence
  Description of Artificial Sequence: Synthetic peptide
  XENP023621 vlCDR2
KGSNRFS

SEQ ID NO: 33468 - protein, 9 aa, Artificial Sequence
  Description of Artificial Sequence: Synthetic peptide
  XENP023621 vlCDR3
FQGSHVPNT

SEQ ID NO: 33469 - protein, 251 aa, Artificial Sequence
  Description of Artificial Sequence: Synthetic polypeptide
  XENP023622 1C11_H3_L3.54_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 33470 - protein, 117 aa, Artificial Sequence; identical to SEQ ID NO: 33034
  Description of Artificial Sequence: Synthetic polypeptide
  VH of XENP023622

SEQ ID NO: 33471 - protein, 114 aa, Artificial Sequence
  Description of Artificial Sequence: Synthetic polypeptide
  VL of XENP023622
DVLMTQSPDSLAVSLGERATINCKSSQSIVHSNGNTYLEWYQQKPGQSPKLLIYKMSNRFSGVPDRFSGSGSGTDFTLTISSLQAEDVAVYYCFQGSHVPNTFGGGTKVEIKGS

SEQ ID NO: 33472 - protein, 5 aa, Artificial Sequence
  Description of Artificial Sequence: Synthetic peptide
  XENP023622 vhCDR1
HYGMN

SEQ ID NO: 33473 - protein, 17 aa, Artificial Sequence
  Description of Artificial Sequence: Synthetic peptide
  XENP023622 vhCDR2
WINTYTGEPTYADGFTG

SEQ ID NO: 33474 - protein, 8 aa, Artificial Sequence
  Description of Artificial Sequence: Synthetic peptide
  XENP023622 vhCDR3
DYYGSSPY

SEQ ID NO: 33475 - protein, 16 aa, Artificial Sequence
  Description of Artificial Sequence: Synthetic peptide
  XENP023622 vlCDR1
KSSQSIVHSNGNTYLE

SEQ ID NO: 33476 - protein, 7 aa, Artificial Sequence
  Description of Artificial Sequence: Synthetic peptide
  XENP023622 vlCDR2
KMSNRFS

SEQ ID NO: 33477 - protein, 9 aa, Artificial Sequence
  Description of Artificial Sequence: Synthetic peptide
  XENP023622 vlCDR3
FQGSHVPNT

SEQ ID NO: 33478 - protein, 251 aa, Artificial Sequence
  Description of Artificial Sequence: Synthetic polypeptide
  XENP023623 1C11_H3_L3.56_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 33479 - protein, 117 aa, Artificial Sequence; identical to SEQ ID NO: 33034
  Description of Artificial Sequence: Synthetic polypeptide
  VH of XENP023623

SEQ ID NO: 33480 - protein, 114 aa, Artificial Sequence
  Description of Artificial Sequence: Synthetic polypeptide
  VL of XENP023623
DVLMTQSPDSLAVSLGERATINCKSSQSIVHSNGNTYLEWYQQKPGQSPKLLIYKVSNRASGVPDRFSGSGSGTDFTLTISSLQAEDVAVYYCFQGSHVPNTFGGGTKVEIKGS

SEQ ID NO: 33481 - protein, 5 aa, Artificial Sequence
  Description of Artificial Sequence: Synthetic peptide
  XENP023623 vhCDR1
HYGMN

SEQ ID NO: 33482 - protein, 17 aa, Artificial Sequence
  Description of Artificial Sequence: Synthetic peptide
  XENP023623 vhCDR2
WINTYTGEPTYADGFTG

SEQ ID NO: 33483 - protein, 8 aa, Artificial Sequence
  Description of Artificial Sequence: Synthetic peptide
  XENP023623 vhCDR3
DYYGSSPY

SEQ ID NO: 33484 - protein, 16 aa, Artificial Sequence
  Description of Artificial Sequence: Synthetic peptide
  XENP023623 vlCDR1
KSSQSIVHSNGNTYLE

SEQ ID NO: 33485 - protein, 7 aa, Artificial Sequence
  Description of Artificial Sequence: Synthetic peptide
  XENP023623 vlCDR2
KVSNRAS

SEQ ID NO: 33486 - protein, 9 aa, Artificial Sequence
  Description of Artificial Sequence: Synthetic peptide
  XENP023623 vlCDR3
FQGSHVPNT

SEQ ID NO: 33487 - protein, 251 aa, Artificial Sequence
  Description of Artificial Sequence: Synthetic polypeptide
  XENP023624 1C11_H3_L3.57_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 33488 - protein, 117 aa, Artificial Sequence; identical to SEQ ID NO: 33034
  Description of Artificial Sequence: Synthetic polypeptide
  VH of XENP023624

SEQ ID NO: 33489 - protein, 114 aa, Artificial Sequence
  Description of Artificial Sequence: Synthetic polypeptide
  VL of XENP023624
DVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIKGS

SEQ ID NO: 33490 - protein, 5 aa, Artificial Sequence
  Description of Artificial Sequence: Synthetic peptide
  XENP023624 vhCDR1
HYGMN

SEQ ID NO: 33491 - protein, 17 aa, Artificial Sequence
  Description of Artificial Sequence: Synthetic peptide
  XENP023624 vhCDR2
WINTYTGEPTYADGFTG

SEQ ID NO: 33492 - protein, 8 aa, Artificial Sequence
  Description of Artificial Sequence: Synthetic peptide
  XENP023624 vhCDR3
DYYGSSPY

SEQ ID NO: 33493 - protein, 16 aa, Artificial Sequence
  Description of Artificial Sequence: Synthetic peptide
  XENP023624 vlCDR1
KSSQSIVHSNGNTYLE

SEQ ID NO: 33494 - protein, 7 aa, Artificial Sequence
  Description of Artificial Sequence: Synthetic peptide
  XENP023624 vlCDR2
KVSNRFT

SEQ ID NO: 33495 - protein, 9 aa, Artificial Sequence
  Description of Artificial Sequence: Synthetic peptide
  XENP023624 vlCDR3
FQGSHVPNT

SEQ ID NO: 33496 - protein, 251 aa, Artificial Sequence
  Description of Artificial Sequence: Synthetic polypeptide
  XENP023625 1C11_H3_L3.58_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 33497 - protein, 117 aa, Artificial Sequence; identical to SEQ ID NO: 33034
  Description of Artificial Sequence: Synthetic polypeptide
  VH of XENP023625

SEQ ID NO: 33498 - protein, 114 aa, Artificial Sequence
  Description of Artificial Sequence: Synthetic polypeptide
  VL of XENP023625
DVLMTQSPDSLAVSLGERATINCKSSQSIVHSNGNTYLEWYQQKPGQSPKLLIYKVSNRFSGVPDRFSGSGSGTDFTLTISGLQAEDVAVYYCFQGSHVPNTFGGGTKVEIKGS

SEQ ID NO: 33499 - protein, 5 aa, Artificial Sequence
  Description of Artificial Sequence: Synthetic peptide
  XENP023625 vhCDR1
HYGMN

SEQ ID NO: 33500 - protein, 17 aa, Artificial Sequence
  Description of Artificial Sequence: Synthetic peptide
  XENP023625 vhCDR2
WINTYTGEPTYADGFTG

SEQ ID NO: 33501 - protein, 8 aa, Artificial Sequence
  Description of Artificial Sequence: Synthetic peptide
  XENP023625 vhCDR3
DYYGSSPY

SEQ ID NO: 33502 - protein, 16 aa, Artificial Sequence
  Description of Artificial Sequence: Synthetic peptide
  XENP023625 vlCDR1
KSSQSIVHSNGNTYLE

SEQ ID NO: 33503 - protein, 7 aa, Artificial Sequence
  Description of Artificial Sequence: Synthetic peptide
  XENP023625 vlCDR2
KVSNRFS

SEQ ID NO: 33504 - protein, 9 aa, Artificial Sequence
  Description of Artificial Sequence: Synthetic peptide
  XENP023625 vlCDR3
FQGSHVPNT

SEQ ID NO: 33505 - protein, 251 aa, Artificial Sequence
  Description of Artificial Sequence: Synthetic polypeptide
  XENP023626 1C11_H3_L3.59_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 33506 - protein, 117 aa, Artificial Sequence; identical to SEQ ID NO: 33034
  Description of Artificial Sequence: Synthetic polypeptide
  VH of XENP023626

SEQ ID NO: 33507 - protein, 114 aa, Artificial Sequence
  Description of Artificial Sequence: Synthetic polypeptide
  VL of XENP023626
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKGS

SEQ ID NO: 33508 - protein, 5 aa, Artificial Sequence
  Description of Artificial Sequence: Synthetic peptide
  XENP023626 vhCDR1
HYGMN

SEQ ID NO: 33509 - protein, 17 aa, Artificial Sequence
  Description of Artificial Sequence: Synthetic peptide
  XENP023626 vhCDR2
WINTYTGEPTYADGFTG

SEQ ID NO: 33510 - protein, 8 aa, Artificial Sequence
  Description of Artificial Sequence: Synthetic peptide
  XENP023626 vhCDR3
DYYGSSPY

SEQ ID NO: 33511 - protein, 16 aa, Artificial Sequence
  Description of Artificial Sequence: Synthetic peptide
  XENP023626 vlCDR1
KSSQSIVHSNGNTYLE

SEQ ID NO: 33512 - protein, 7 aa, Artificial Sequence
  Description of Artificial Sequence: Synthetic peptide
  XENP023626 vlCDR2
KVSNRFS

SEQ ID NO: 33513 - protein, 9 aa, Artificial Sequence
  Description of Artificial Sequence: Synthetic peptide
  XENP023626 vlCDR3
FQGSHVPNT

SEQ ID NO: 33514 - protein, 251 aa, Artificial Sequence
  Description of Artificial Sequence: Synthetic polypeptide
  XENP023627 1C11_H3_L3.60_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 33515 - protein, 117 aa, Artificial Sequence; identical to SEQ ID NO: 33034
  Description of Artificial Sequence: Synthetic polypeptide
  VH of XENP023627

SEQ ID NO: 33516 - protein, 114 aa, Artificial Sequence
  Description of Artificial Sequence: Synthetic polypeptide
  VL of XENP023627
DVLMTQSPDSLAVSLGERATINCKSSQSIVHSNGNTYLEWYQQKPGQSPKLLIYKVSNRFSGVPDRFSGSGSGTDFTLTISNLQAEDVAVYYCFQGSHVPNTFGGGTKVEIKGS

SEQ ID NO: 33517 - protein, 5 aa, Artificial Sequence
  Description of Artificial Sequence: Synthetic peptide
  XENP023627 vhCDR1
HYGMN

SEQ ID NO: 33518 - protein, 17 aa, Artificial Sequence
  Description of Artificial Sequence: Synthetic peptide
  XENP023627 vhCDR2
WINTYTGEPTYADGFTG

SEQ ID NO: 33519 - protein, 8 aa, Artificial Sequence
  Description of Artificial Sequence: Synthetic peptide
  XENP023627 vhCDR3
DYYGSSPY

SEQ ID NO: 33520 - protein, 16 aa, Artificial Sequence
  Description of Artificial Sequence: Synthetic peptide
  XENP023627 vlCDR1
KSSQSIVHSNGNTYLE

SEQ ID NO: 33521 - protein, 7 aa, Artificial Sequence
  Description of Artificial Sequence: Synthetic peptide
  XENP023627 vlCDR2
KVSNRFS

SEQ ID NO: 33522 - protein, 9 aa, Artificial Sequence
  Description of Artificial Sequence: Synthetic peptide
  XENP023627 vlCDR3
FQGSHVPNT

SEQ ID NO: 33523 - protein, 251 aa, Artificial Sequence
  Description of Artificial Sequence: Synthetic polypeptide
  XENP023628 1C11_H3_L3.62_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 33524 - protein, 117 aa, Artificial Sequence; identical to SEQ ID NO: 33034
  Description of Artificial Sequence: Synthetic polypeptide
  VH of XENP023628

SEQ ID NO: 33525 - protein, 114 aa, Artificial Sequence
  Description of Artificial Sequence: Synthetic polypeptide
  VL of XENP023628
DVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIKGS

SEQ ID NO: 33526 - protein, 5 aa, Artificial Sequence
  Description of Artificial Sequence: Synthetic peptide
  XENP023628 vhCDR1
HYGMN

SEQ ID NO: 33527 - protein, 17 aa, Artificial Sequence
  Description of Artificial Sequence: Synthetic peptide
  XENP023628 vhCDR2
WINTYTGEPTYADGFTG

SEQ ID NO: 33528 - protein, 8 aa, Artificial Sequence
  Description of Artificial Sequence: Synthetic peptide
  XENP023628 vhCDR3
DYYGSSPY

SEQ ID NO: 33529 - protein, 16 aa, Artificial Sequence
  Description of Artificial Sequence: Synthetic peptide
  XENP023628 vlCDR1
KSSQSIVHSNGNTYLE

SEQ ID NO: 33530 - protein, 7 aa, Artificial Sequence
  Description of Artificial Sequence: Synthetic peptide
  XENP023628 vlCDR2
KVSNRFS

SEQ ID NO: 33531 - protein, 9 aa, Artificial Sequence
  Description of Artificial Sequence: Synthetic peptide
  XENP023628 vlCDR3
FQGSHVPNT

SEQ ID NO: 33532 - protein, 251 aa, Artificial Sequence
  Description of Artificial Sequence: Synthetic polypeptide
  XENP023629 1C11_H3_L3.63_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 33533 - protein, 117 aa, Artificial Sequence; identical to SEQ ID NO: 33034
  Description of Artificial Sequence: Synthetic polypeptide
  VH of XENP023629

SEQ ID NO: 33534 - protein, 114 aa, Artificial Sequence
  Description of Artificial Sequence: Synthetic polypeptide
  VL of XENP023629
DVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIKGS

SEQ ID NO: 33535 - protein, 5 aa, Artificial Sequence
  Description of Artificial Sequence: Synthetic peptide
  XENP023629 vhCDR1
HYGMN

SEQ ID NO: 33536 - protein, 17 aa, Artificial Sequence
  Description of Artificial Sequence: Synthetic peptide
  XENP023629 vhCDR2
WINTYTGEPTYADGFTG

SEQ ID NO: 33537 - protein, 8 aa, Artificial Sequence
  Description of Artificial Sequence: Synthetic peptide
  XENP023629 vhCDR3
DYYGSSPY

SEQ ID NO: 33538 - protein, 16 aa, Artificial Sequence
  Description of Artificial Sequence: Synthetic peptide
  XENP023629 vlCDR1
KSSQSIVHSNGNTYLE

SEQ ID NO: 33539 - protein, 7 aa, Artificial Sequence
  Description of Artificial Sequence: Synthetic peptide
  XENP023629 vlCDR2
KVSNRFS

SEQ ID NO: 33540 - protein, 9 aa, Artificial Sequence
  Description of Artificial Sequence: Synthetic peptide
  XENP023629 vlCDR3
FQGSHVPNT

SEQ ID NO: 33541 - protein, 251 aa, Artificial Sequence
  Description of Artificial Sequence: Synthetic polypeptide
  XENP023630 1C11_H3_L3.64_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 33542 - protein, 117 aa, Artificial Sequence; identical to SEQ ID NO: 33034
  Description of Artificial Sequence: Synthetic polypeptide
  VH of XENP023630

SEQ ID NO: 33543 - protein, 114 aa, Artificial Sequence
  Description of Artificial Sequence: Synthetic polypeptide
  VL of XENP023630
DVLMTQSPDSLAVSLGERATINCKSSQSIVHSNGNTYLEWYQQKPGQSPKLLIYKVSNRFSGVPDRFSGSGSGTDFTLTISSAQAEDVAVYYCFQGSHVPNTFGGGTKVEIKGS

SEQ ID NO: 33544 - protein, 5 aa, Artificial Sequence
  Description of Artificial Sequence: Synthetic peptide
  XENP023630 vhCDR1
HYGMN

SEQ ID NO: 33545 - protein, 17 aa, Artificial Sequence
  Description of Artificial Sequence: Synthetic peptide
  XENP023630 vhCDR2
WINTYTGEPTYADGFTG

SEQ ID NO: 33546 - protein, 8 aa, Artificial Sequence
  Description of Artificial Sequence: Synthetic peptide
  XENP023630 vhCDR3
DYYGSSPY

SEQ ID NO: 33547 - protein, 16 aa, Artificial Sequence
  Description of Artificial Sequence: Synthetic peptide
  XENP023630 vlCDR1
KSSQSIVHSNGNTYLE

SEQ ID NO: 33548 - protein, 7 aa, Artificial Sequence
  Description of Artificial Sequence: Synthetic peptide
  XENP023630 vlCDR2
KVSNRFS

SEQ ID NO: 33549 - protein, 9 aa, Artificial Sequence
  Description of Artificial Sequence: Synthetic peptide
  XENP023630 vlCDR3
FQGSHVPNT

SEQ ID NO: 33550 - protein, 251 aa, Artificial Sequence
  Description of Artificial Sequence: Synthetic polypeptide
  XENP023631 1C11_H3_L3.65_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 33551 - protein, 117 aa, Artificial Sequence; identical to SEQ ID NO: 33034
  Description of Artificial Sequence: Synthetic polypeptide
  VH of XENP023631

SEQ ID NO: 33552 - protein, 114 aa, Artificial Sequence
  Description of Artificial Sequence: Synthetic polypeptide
  VL of XENP023631
DVLMTQSPDSLAVSLGERATINCKSSQSIVHSNGNTYLEWYQQKPGQSPKLLIYKVSNRFSGVPDRFSGSGSGTDFTLTISSLEAEDVAVYYCFQGSHVPNTFGGGTKVEIKGS

SEQ ID NO: 33553 - protein, 5 aa, Artificial Sequence
  Description of Artificial Sequence: Synthetic peptide
  XENP023631 vhCDR1
HYGMN

SEQ ID NO: 33554 - protein, 17 aa, Artificial Sequence
  Description of Artificial Sequence: Synthetic peptide
  XENP023631 vhCDR2
WINTYTGEPTYADGFTG

SEQ ID NO: 33555 - protein, 8 aa, Artificial Sequence
  Description of Artificial Sequence: Synthetic peptide
  XENP023631 vhCDR3
DYYGSSPY

SEQ ID NO: 33556 - protein, 16 aa, Artificial Sequence
  Description of Artificial Sequence: Synthetic peptide
  XENP023631 vlCDR1
KSSQSIVHSNGNTYLE

SEQ ID NO: 33557 - protein, 7 aa, Artificial Sequence
  Description of Artificial Sequence: Synthetic peptide
  XENP023631 vlCDR2
KVSNRFS

SEQ ID NO: 33558 - protein, 9 aa, Artificial Sequence
  Description of Artificial Sequence: Synthetic peptide
  XENP023631 vlCDR3
FQGSHVPNT

SEQ ID NO: 33559 - protein, 251 aa, Artificial Sequence
  Description of Artificial Sequence: Synthetic polypeptide
  XENP023632 1C11_H3_L3.66_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 33560 - protein, 117 aa, Artificial Sequence; identical to SEQ ID NO: 33034
  Description of Artificial Sequence: Synthetic polypeptide
  VH of XENP023632

SEQ ID NO: 33561 - protein, 114 aa, Artificial Sequence
  Description of Artificial Sequence: Synthetic polypeptide
  VL of XENP023632
DVLMTQSPDSLAVSLGERATINCKSSQSIVHSNGNTYLEWYQQKPGQSPKLLIYKVSNRFSGVPDRFSGSGSGTDFTLTISSLQPEDVAVYYCFQGSHVPNTFGGGTKVEIKGS

SEQ ID NO: 33562 - protein, 5 aa, Artificial Sequence
  Description of Artificial Sequence: Synthetic peptide
  XENP023632 vhCDR1
HYGMN

SEQ ID NO: 33563 - protein, 17 aa, Artificial Sequence
  Description of Artificial Sequence: Synthetic peptide
  XENP023632 vhCDR2
WINTYTGEPTYADGFTG

SEQ ID NO: 33564 - protein, 8 aa, Artificial Sequence
  Description of Artificial Sequence: Synthetic peptide
  XENP023632 vhCDR3
DYYGSSPY

SEQ ID NO: 33565 - protein, 16 aa, Artificial Sequence
  Description of Artificial Sequence: Synthetic peptide
  XENP023632 vlCDR1
KSSQSIVHSNGNTYLE

SEQ ID NO: 33566 - protein, 7 aa, Artificial Sequence
  Description of Artificial Sequence: Synthetic peptide
  XENP023632 vlCDR2
KVSNRFS

SEQ ID NO: 33567 - protein, 9 aa, Artificial Sequence
  Description of Artificial Sequence: Synthetic peptide
  XENP023632 vlCDR3
FQGSHVPNT

SEQ ID NO: 33568 - protein, 251 aa, Artificial Sequence
  Description of Artificial Sequence: Synthetic polypeptide
  XENP023633 1C11_H3_L3.69_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 33569 - protein, 117 aa, Artificial Sequence; identical to SEQ ID NO: 33034
  Description of Artificial Sequence: Synthetic polypeptide
  VH of XENP023633

SEQ ID NO: 33570 - protein, 114 aa, Artificial Sequence
  Description of Artificial Sequence: Synthetic polypeptide
  VL of XENP023633
DVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIKGS

SEQ ID NO: 33571 - protein, 5 aa, Artificial Sequence
  Description of Artificial Sequence: Synthetic peptide
  XENP023633 vhCDR1
HYGMN

SEQ ID NO: 33572 - protein, 17 aa, Artificial Sequence
  Description of Artificial Sequence: Synthetic peptide
  XENP023633 vhCDR2
WINTYTGEPTYADGFTG

SEQ ID NO: 33573 - protein, 8 aa, Artificial Sequence
  Description of Artificial Sequence: Synthetic peptide
  XENP023633 vhCDR3
DYYGSSPY

SEQ ID NO: 33574 - protein, 16 aa, Artificial Sequence
  Description of Artificial Sequence: Synthetic peptide
  XENP023633 vlCDR1
KSSQSIVHSNGNTYLE

SEQ ID NO: 33575 - protein, 7 aa, Artificial Sequence
  Description of Artificial Sequence: Synthetic peptide
  XENP023633 vlCDR2
KVSNRFS

SEQ ID NO: 33576 - protein, 9 aa, Artificial Sequence
  Description of Artificial Sequence: Synthetic peptide
  XENP023633 vlCDR3
FQGSHVPNT

SEQ ID NO: 33577 - protein, 251 aa, Artificial Sequence
  Description of Artificial Sequence: Synthetic polypeptide
  XENP023634 1C11_H3_L3.70_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 33578 - protein, 117 aa, Artificial Sequence; identical to SEQ ID NO: 33034
  Description of Artificial Sequence: Synthetic polypeptide
  VH of XENP023634

SEQ ID NO: 33579 - protein, 114 aa, Artificial Sequence
  Description of Artificial Sequence: Synthetic polypeptide
  VL of XENP023634
DVLMTQSPDSLAVSLGERATINCKSSQSIVHSNGNTYLEWYQQKPGQSPKLLIYKVSNRFSGVPDRFSGSGSGTDFTLTISSLQAEDFAVYYCFQGSHVPNTFGGGTKVEIKGS

SEQ ID NO: 33580 - protein, 5 aa, Artificial Sequence
  Description of Artificial Sequence: Synthetic peptide
  XENP023634 vhCDR1
HYGMN

SEQ ID NO: 33581 - protein, 17 aa, Artificial Sequence
  Description of Artificial Sequence: Synthetic peptide
  XENP023634 vhCDR2
WINTYTGEPTYADGFTG

SEQ ID NO: 33582 - protein, 8 aa, Artificial Sequence
  Description of Artificial Sequence: Synthetic peptide
  XENP023634 vhCDR3
DYYGSSPY

SEQ ID NO: 33583 - protein, 16 aa, Artificial Sequence
  Description of Artificial Sequence: Synthetic peptide
  XENP023634 vlCDR1
KSSQSIVHSNGNTYLE

SEQ ID NO: 33584 - protein, 7 aa, Artificial Sequence
  Description of Artificial Sequence: Synthetic peptide
  XENP023634 vlCDR2
KVSNRFS

SEQ ID NO: 33585 - protein, 9 aa, Artificial Sequence
  Description of Artificial Sequence: Synthetic peptide
  XENP023634 vlCDR3
FQGSHVPNT

SEQ ID NO: 33586 - protein, 251 aa, Artificial Sequence
  Description of Artificial Sequence: Synthetic polypeptide
  XENP023635 1C11_H3_L3.72_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 33587 - protein, 117 aa, Artificial Sequence; identical to SEQ ID NO: 33034
  Description of Artificial Sequence: Synthetic polypeptide
  VH of XENP023635

SEQ ID NO: 33588 - protein, 114 aa, Artificial Sequence
  Description of Artificial Sequence: Synthetic polypeptide
  VL of XENP023635
DVLMTQSPDSLAVSLGERATINCKSSQSIVHSNGNTYLEWYQQKPGQSPKLLIYKVSNRFSGVPDRFSGSGSGTDFTLTISSLQAEDVADYYCFQGSHVPNTFGGGTKVEIKGS

SEQ ID NO: 33589 - protein, 5 aa, Artificial Sequence
  Description of Artificial Sequence: Synthetic peptide
  XENP023635 vhCDR1
HYGMN

SEQ ID NO: 33590 - protein, 17 aa, Artificial Sequence
  Description of Artificial Sequence: Synthetic peptide
  XENP023635 vhCDR2
WINTYTGEPTYADGFTG

SEQ ID NO: 33591 - protein, 8 aa, Artificial Sequence
  Description of Artificial Sequence: Synthetic peptide
  XENP023635 vhCDR3
DYYGSSPY

SEQ ID NO: 33592 - protein, 16 aa, Artificial Sequence
  Description of Artificial Sequence: Synthetic peptide
  XENP023635 vlCDR1
KSSQSIVHSNGNTYLE

SEQ ID NO: 33593 - protein, 7 aa, Artificial Sequence
  Description of Artificial Sequence: Synthetic peptide
  XENP023635 vlCDR2
KVSNRFS

SEQ ID NO: 33594 - protein, 9 aa, Artificial Sequence
  Description of Artificial Sequence: Synthetic peptide
  XENP023635 vlCDR3
FQGSHVPNT

SEQ ID NO: 33595 - protein, 251 aa, Artificial Sequence
  Description of Artificial Sequence: Synthetic polypeptide
  XENP023636 1C11_H3_L3.73_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 33596 - protein, 117 aa, Artificial Sequence; identical to SEQ ID NO: 33034
  Description of Artificial Sequence: Synthetic polypeptide
  VH of XENP023636

SEQ ID NO: 33597 - protein, 114 aa, Artificial Sequence
  Description of Artificial Sequence: Synthetic polypeptide
  VL of XENP023636
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKGS

SEQ ID NO: 33598 - protein, 5 aa, Artificial Sequence
  Description of Artificial Sequence: Synthetic peptide
  XENP023636 vhCDR1
HYGMN

SEQ ID NO: 33599 - protein, 17 aa, Artificial Sequence
  Description of Artificial Sequence: Synthetic peptide
  XENP023636 vhCDR2
WINTYTGEPTYADGFTG

SEQ ID NO: 33600 - protein, 8 aa, Artificial Sequence
  Description of Artificial Sequence: Synthetic peptide
  XENP023636 vhCDR3
DYYGSSPY

SEQ ID NO: 33601 - protein, 16 aa, Artificial Sequence
  Description of Artificial Sequence: Synthetic peptide
  XENP023636 vlCDR1
KSSQSIVHSNGNTYLE

SEQ ID NO: 33602 - protein, 7 aa, Artificial Sequence
  Description of Artificial Sequence: Synthetic peptide
  XENP023636 vlCDR2
KVSNRFS

SEQ ID NO: 33603 - protein, 9 aa, Artificial Sequence
  Description of Artificial Sequence: Synthetic peptide
  XENP023636 vlCDR3
FQGSHVPNT

SEQ ID NO: 33604 - protein, 251 aa, Artificial Sequence
  Description of Artificial Sequence: Synthetic polypeptide
  XENP023637 1C11_H3_L3.75_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 33605 - protein, 117 aa, Artificial Sequence; identical to SEQ ID NO: 33034
  Description of Artificial Sequence: Synthetic polypeptide
  VH of XENP023637

SEQ ID NO: 33606 - protein, 114 aa, Artificial Sequence
  Description of Artificial Sequence: Synthetic polypeptide
  VL of XENP023637
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCLQGSHVPNTFGGGTKVEIKGS

SEQ ID NO: 33607 - protein, 5 aa, Artificial Sequence
  Description of Artificial Sequence: Synthetic peptide
  XENP023637 vhCDR1
HYGMN

SEQ ID NO: 33608 - protein, 17 aa, Artificial Sequence
  Description of Artificial Sequence: Synthetic peptide
  XENP023637 vhCDR2
WINTYTGEPTYADGFTG

SEQ ID NO: 33609 - protein, 8 aa, Artificial Sequence
  Description of Artificial Sequence: Synthetic peptide
  XENP023637 vhCDR3
DYYGSSPY

SEQ ID NO: 33610 - protein, 16 aa, Artificial Sequence
  Description of Artificial Sequence: Synthetic peptide
  XENP023637 vlCDR1
KSSQSIVHSNGNTYLE

SEQ ID NO: 33611 - protein, 7 aa, Artificial Sequence
  Description of Artificial Sequence: Synthetic peptide
  XENP023637 vlCDR2
KVSNRFS

SEQ ID NO: 33612 - protein, 9 aa, Artificial Sequence
  Description of Artificial Sequence: Synthetic peptide
  XENP023637 vlCDR3
LQGSHVPNT

SEQ ID NO: 33613 - protein, 251 aa, Artificial Sequence
  Description of Artificial Sequence: Synthetic polypeptide
  XENP023638 1C11_H3_L3.78_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 33614 - protein, 117 aa, Artificial Sequence; identical to SEQ ID NO: 33034
  Description of Artificial Sequence: Synthetic polypeptide
  VH of XENP023638

SEQ ID NO: 33615 - protein, 114 aa, Artificial Sequence
  Description of Artificial Sequence: Synthetic polypeptide
  VL of XENP023638
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVGNTFGGGTKVEIKGS

SEQ ID NO: 33616 - protein, 5 aa, Artificial Sequence
  Description of Artificial Sequence: Synthetic peptide
  XENP023638 vhCDR1
HYGMN

SEQ ID NO: 33617 - protein, 17 aa, Artificial Sequence
  Description of Artificial Sequence: Synthetic peptide
  XENP023638 vhCDR2
WINTYTGEPTYADGFTG

SEQ ID NO: 33618 - protein, 8 aa, Artificial Sequence
  Description of Artificial Sequence: Synthetic peptide
  XENP023638 vhCDR3
DYYGSSPY

SEQ ID NO: 33619 - protein, 16 aa, Artificial Sequence
  Description of Artificial Sequence: Synthetic peptide
  XENP023638 vlCDR1
KSSQSIVHSNGNTYLE

SEQ ID NO: 33620 - protein, 7 aa, Artificial Sequence
  Description of Artificial Sequence: Synthetic peptide
  XENP023638 vlCDR2
KVSNRFS

SEQ ID NO: 33621 - protein, 9 aa, Artificial Sequence
  Description of Artificial Sequence: Synthetic peptide
  XENP023638 vlCDR3
FQGSHVGNT

SEQ ID NO: 33622 - protein, 251 aa, Artificial Sequence
  Description of Artificial Sequence: Synthetic polypeptide
  XENP023639 1C11_H3_L3.79_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 33623 - protein, 117 aa, Artificial Sequence; identical to SEQ ID NO: 33034
  Description of Artificial Sequence: Synthetic polypeptide
  VH of XENP023639

SEQ ID NO: 33624 - protein, 114 aa, Artificial Sequence
  Description of Artificial Sequence: Synthetic polypeptide
  VL of XENP023639
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVHNTFGGGTKVEIKGS

SEQ ID NO: 33625 - protein, 5 aa, Artificial Sequence
  Description of Artificial Sequence: Synthetic peptide
  XENP023639 vhCDR1
HYGMN

SEQ ID NO: 33626 - protein, 17 aa, Artificial Sequence
  Description of Artificial Sequence: Synthetic peptide
  XENP023639 vhCDR2
WINTYTGEPTYADGFTG

SEQ ID NO: 33627 - protein, 8 aa, Artificial Sequence
  Description of Artificial Sequence: Synthetic peptide
  XENP023639 vhCDR3
DYYGSSPY

SEQ ID NO: 33628 - protein, 16 aa, Artificial Sequence
  Description of Artificial Sequence: Synthetic peptide
  XENP023639 vlCDR1
KSSQSIVHSNGNTYLE

SEQ ID NO: 33629 - protein, 7 aa, Artificial Sequence
  Description of Artificial Sequence: Synthetic peptide
  XENP023639 vlCDR2
KVSNRFS

SEQ ID NO: 33630 - protein, 9 aa, Artificial Sequence
  Description of Artificial Sequence: Synthetic peptide
  XENP023639 vlCDR3
FQGSHVHNT

SEQ ID NO: 33631 - protein, 251 aa, Artificial Sequence
  Description of Artificial Sequence: Synthetic polypeptide
  XENP023640 1C11_H3_L3.81_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 33632 - protein, 117 aa, Artificial Sequence; identical to SEQ ID NO: 33034
  Description of Artificial Sequence: Synthetic polypeptide
  VH of XENP023640

SEQ ID NO: 33633 - protein, 114 aa, Artificial Sequence
  Description of Artificial Sequence: Synthetic polypeptide
  VL of XENP023640
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIKGS

SEQ ID NO: 33634 - protein, 5 aa, Artificial Sequence
  Description of Artificial Sequence: Synthetic peptide
  XENP023640 vhCDR1
HYGMN

SEQ ID NO: 33635 - protein, 17 aa, Artificial Sequence
  Description of Artificial Sequence: Synthetic peptide
  XENP023640 vhCDR2
WINTYTGEPTYADGFTG

SEQ ID NO: 33636 - protein, 8 aa, Artificial Sequence
  Description of Artificial Sequence: Synthetic peptide
  XENP023640 vhCDR3
DYYGSSPY

SEQ ID NO: 33637 - protein, 16 aa, Artificial Sequence
  Description of Artificial Sequence: Synthetic peptide
  XENP023640 vlCDR1
KSSQSIVHSNGNTYLE

SEQ ID NO: 33638 - protein, 7 aa, Artificial Sequence
  Description of Artificial Sequence: Synthetic peptide
  XENP023640 vlCDR2
KVSNRFS

SEQ ID NO: 33639 - protein, 9 aa, Artificial Sequence
  Description of Artificial Sequence: Synthetic peptide
  XENP023640 vlCDR3
FQGSHVPNT

SEQ ID NO: 33640 - protein, 251 aa, Artificial Sequence
  Description of Artificial Sequence: Synthetic polypeptide
  XENP023641 1C11_H3_L3.82_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 33641 - protein, 117 aa, Artificial Sequence; identical to SEQ ID NO: 33034
  Description of Artificial Sequence: Synthetic polypeptide
  VH of XENP023641

SEQ ID NO: 33642 - protein, 114 aa, Artificial Sequence
  Description of Artificial Sequence: Synthetic polypeptide
  VL of XENP023641
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKLEIKGS

SEQ ID NO: 33643 - protein, 5 aa, Artificial Sequence
  Description of Artificial Sequence: Synthetic peptide
  XENP023641 vhCDR1
HYGMN

SEQ ID NO: 33644 - protein, 17 aa, Artificial Sequence
  Description of Artificial Sequence: Synthetic peptide
  XENP023641 vhCDR2
WINTYTGEPTYADGFTG

SEQ ID NO: 33645 - protein, 8 aa, Artificial Sequence
  Description of Artificial Sequence: Synthetic peptide
  XENP023641 vhCDR3
DYYGSSPY

SEQ ID NO: 33646 - protein, 16 aa, Artificial Sequence
  Description of Artificial Sequence: Synthetic peptide
  XENP023641 vlCDR1
KSSQSIVHSNGNTYLE

SEQ ID NO: 33647 - protein, 7 aa, Artificial Sequence
  Description of Artificial Sequence: Synthetic peptide
  XENP023641 vlCDR2
KVSNRFS

SEQ ID NO: 33648 - protein, 9 aa, Artificial Sequence
  Description of Artificial Sequence: Synthetic peptide
  XENP023641 vlCDR3
FQGSHVPNT

SEQ ID NO: 33649 - protein, 251 aa, Artificial Sequence
  Description of Artificial Sequence: Synthetic polypeptide
  XENP023755 1C11_H3.1_L3_scFv
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33650 - protein, 117 aa, Artificial Sequence
  Description of Artificial Sequence: Synthetic polypeptide
  VH of XENP023755
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33651 - protein, 114 aa, Artificial Sequence
  Description of Artificial Sequence: Synthetic polypeptide
  VL of XENP023755
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33652 - protein, 5 aa, Artificial Sequence
  Description of Artificial Sequence: Synthetic peptide
  XENP023755 vhCDR1
HYGMN

SEQ ID NO: 33653 - protein, 17 aa, Artificial Sequence
  Description of Artificial Sequence: Synthetic peptide
  XENP023755 vhCDR2
WINTYTGEPTYADGFTG

SEQ ID NO: 33654 - protein, 8 aa, Artificial Sequence
  Description of Artificial Sequence: Synthetic peptide
  XENP023755 vhCDR3
DYYGSSPY

SEQ ID NO: 33655 - protein, 16 aa, Artificial Sequence
  Description of Artificial Sequence: Synthetic peptide
  XENP023755 vlCDR1
KSSQSIVHSNGNTYLE

SEQ ID NO: 33656 - protein, 7 aa, Artificial Sequence
  Description of Artificial Sequence: Synthetic peptide
  XENP023755 vlCDR2
KVSNRFS

SEQ ID NO: 33657 - protein, 9 aa, Artificial Sequence
  Description of Artificial Sequence: Synthetic peptide
  XENP023755 vlCDR3
FQGSHVPNT

SEQ ID NO: 33658 - protein, 251 aa, Artificial Sequence
  Description of Artificial Sequence: Synthetic polypeptide
  XENP023756 1C11_H3.2_L3_scFv
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33659 - protein, 117 aa, Artificial Sequence
  Description of Artificial Sequence: Synthetic polypeptide
  VH of XENP023756
QMQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33660 - protein, 114 aa, Artificial Sequence; identical to SEQ ID NO: 33651
  Description of Artificial Sequence: Synthetic polypeptide
  VL of XENP023756

SEQ ID NO: 33661 - protein, 5 aa, Artificial Sequence
  Description of Artificial Sequence: Synthetic peptide
  XENP023756 vhCDR1
HYGMN

SEQ ID NO: 33662 - protein, 17 aa, Artificial Sequence
  Description of Artificial Sequence: Synthetic peptide
  XENP023756 vhCDR2
WINTYTGEPTYADGFTG

SEQ ID NO: 33663 - protein, 8 aa, Artificial Sequence
  Description of Artificial Sequence: Synthetic peptide
  XENP023756 vhCDR3
DYYGSSPY

SEQ ID NO: 33664 - protein, 16 aa, Artificial Sequence
  Description of Artificial Sequence: Synthetic peptide
  XENP023756 vlCDR1
KSSQSIVHSNGNTYLE

SEQ ID NO: 33665 - protein, 7 aa, Artificial Sequence
  Description of Artificial Sequence: Synthetic peptide
  XENP023756 vlCDR2
KVSNRFS

SEQ ID NO: 33666 - protein, 9 aa, Artificial Sequence
  Description of Artificial Sequence: Synthetic peptide
  XENP023756 vlCDR3
FQGSHVPNT

SEQ ID NO: 33667 - protein, 251 aa, Artificial Sequence
  Description of Artificial Sequence: Synthetic polypeptide
  XENP023757 1C11_H3.4_L3_scFv
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33668 - protein, 117 aa, Artificial Sequence
  Description of Artificial Sequence: Synthetic polypeptide
  VH of XENP023757
QIQLQQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33669 - protein, 114 aa, Artificial Sequence; identical to SEQ ID NO: 33651
  Description of Artificial Sequence: Synthetic polypeptide
  VL of XENP023757

SEQ ID NO: 33670 - protein, 5 aa, Artificial Sequence
  Description of Artificial Sequence: Synthetic peptide
  XENP023757 vhCDR1
HYGMN

SEQ ID NO: 33671 - protein, 17 aa, Artificial Sequence
  Description of Artificial Sequence: Synthetic peptide
  XENP023757 vhCDR2
WINTYTGEPTYADGFTG

SEQ ID NO: 33672 - protein, 8 aa, Artificial Sequence
  Description of Artificial Sequence: Synthetic peptide
  XENP023757 vhCDR3
DYYGSSPY

SEQ ID NO: 33673 - protein, 16 aa, Artificial Sequence
  Description of Artificial Sequence: Synthetic peptide
  XENP023757 vlCDR1
KSSQSIVHSNGNTYLE

SEQ ID NO: 33674 - protein, 7 aa, Artificial Sequence
  Description of Artificial Sequence: Synthetic peptide
  XENP023757 vlCDR2
KVSNRFS

SEQ ID NO: 33675 - protein, 9 aa, Artificial Sequence
  Description of Artificial Sequence: Synthetic peptide
  XENP023757 vlCDR3
FQGSHVPNT

SEQ ID NO: 33676 - protein, 251 aa, Artificial Sequence
  Description of Artificial Sequence: Synthetic polypeptide
  XENP023758 1C11_H3.5_L3_scFv
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33677 - protein, 117 aa, Artificial Sequence
  Description of Artificial Sequence: Synthetic polypeptide
  VH of XENP023758
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33678 - protein, 114 aa, Artificial Sequence; identical to SEQ ID NO: 33651
  Description of Artificial Sequence: Synthetic polypeptide
  VL of XENP023758

SEQ ID NO: 33679 - protein, 5 aa, Artificial Sequence
  Description of Artificial Sequence: Synthetic peptide
  XENP023758 vhCDR1
HYGMN

SEQ ID NO: 33680 - protein, 17 aa, Artificial Sequence
  Description of Artificial Sequence: Synthetic peptide
  XENP023758 vhCDR2
WINTYTGEPTYADGFTG

SEQ ID NO: 33681 - protein, 8 aa, Artificial Sequence
  Description of Artificial Sequence: Synthetic peptide
  XENP023758 vhCDR3
DYYGSSPY

SEQ ID NO: 33682 - protein, 16 aa, Artificial Sequence
  Description of Artificial Sequence: Synthetic peptide
  XENP023758 vlCDR1
KSSQSIVHSNGNTYLE

SEQ ID NO: 33683 - protein, 7 aa, Artificial Sequence
  Description of Artificial Sequence: Synthetic peptide
  XENP023758 vlCDR2
KVSNRFS

SEQ ID NO: 33684 - protein, 9 aa, Artificial Sequence
  Description of Artificial Sequence: Synthetic peptide
  XENP023758 vlCDR3
FQGSHVPNT

SEQ ID NO: 33685 - protein, 251 aa, Artificial Sequence
  Description of Artificial Sequence: Synthetic polypeptide
  XENP023759 1C11_H3.6_L3_scFv
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33686 - protein, 117 aa, Artificial Sequence
  Description of Artificial Sequence: Synthetic polypeptide
  VH of XENP023759
QIQLVQSGGELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33687 - protein, 114 aa, Artificial Sequence; identical to SEQ ID NO: 33651
  Description of Artificial Sequence: Synthetic polypeptide
  VL of XENP023759

SEQ ID NO: 33688 - protein, 5 aa, Artificial Sequence
  Description of Artificial Sequence: Synthetic peptide
  XENP023759 vhCDR1
HYGMN

SEQ ID NO: 33689 - protein, 17 aa, Artificial Sequence
  Description of Artificial Sequence: Synthetic peptide
  XENP023759 vhCDR2
WINTYTGEPTYADGFTG

SEQ ID NO: 33690 - protein, 8 aa, Artificial Sequence
  Description of Artificial Sequence: Synthetic peptide
  XENP023759 vhCDR3
DYYGSSPY

SEQ ID NO: 33691 - protein, 16 aa, Artificial Sequence
  Description of Artificial Sequence: Synthetic peptide
  XENP023759 vlCDR1
KSSQSIVHSNGNTYLE

SEQ ID NO: 33692 - protein, 7 aa, Artificial Sequence
  Description of Artificial Sequence: Synthetic peptide
  XENP023759 vlCDR2
KVSNRFS

SEQ ID NO: 33693 - protein, 9 aa, Artificial Sequence
  Description of Artificial Sequence: Synthetic peptide
  XENP023759 vlCDR3
FQGSHVPNT

SEQ ID NO: 33694 - protein, 251 aa, Artificial Sequence
  Description of Artificial Sequence: Synthetic polypeptide
  XENP023760 1C11_H3.7_L3_scFv
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33695 - protein, 117 aa, Artificial Sequence
  Description of Artificial Sequence: Synthetic polypeptide
  VH of XENP023760
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33696 - protein, 114 aa, Artificial Sequence; identical to SEQ ID NO: 33651
  Description of Artificial Sequence: Synthetic polypeptide
  VL of XENP023760

SEQ ID NO: 33697 - protein, 5 aa, Artificial Sequence
  Description of Artificial Sequence: Synthetic peptide
  XENP023760 vhCDR1
HYGMN

SEQ ID NO: 33698 - protein, 17 aa, Artificial Sequence
  Description of Artificial Sequence: Synthetic peptide
  XENP023760 vhCDR2
WINTYTGEPTYADGFTG

SEQ ID NO: 33699 - protein, 8 aa, Artificial Sequence
  Description of Artificial Sequence: Synthetic peptide
  XENP023760 vhCDR3
DYYGSSPY

SEQ ID NO: 33700 - protein, 16 aa, Artificial Sequence
  Description of Artificial Sequence: Synthetic peptide
  XENP023760 vlCDR1
KSSQSIVHSNGNTYLE

SEQ ID NO: 33701 - protein, 7 aa, Artificial Sequence
  Description of Artificial Sequence: Synthetic peptide
  XENP023760 vlCDR2
KVSNRFS

SEQ ID NO: 33702 - protein, 9 aa, Artificial Sequence
  Description of Artificial Sequence: Synthetic peptide
  XENP023760 vlCDR3
FQGSHVPNT

SEQ ID NO: 33703 - protein, 251 aa, Artificial Sequence
  Description of Artificial Sequence: Synthetic polypeptide
  XENP023761 1C11_H3.8_L3_scFv
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33704 - protein, 117 aa, Artificial Sequence
  Description of Artificial Sequence: Synthetic polypeptide
  VH of XENP023761
QIQLVQSGHELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33705 - protein, 114 aa, Artificial Sequence; identical to SEQ ID NO: 33651
  Description of Artificial Sequence: Synthetic polypeptide
  VL of XENP023761

SEQ ID NO: 33706 - protein, 5 aa, Artificial Sequence
  Description of Artificial Sequence: Synthetic peptide
  XENP023761 vhCDR1
HYGMN

SEQ ID NO: 33707 - protein, 17 aa, Artificial Sequence
  Description of Artificial Sequence: Synthetic peptide
  XENP023761 vhCDR2
WINTYTGEPTYADGFTG

SEQ ID NO: 33708 - protein, 8 aa, Artificial Sequence
  Description of Artificial Sequence: Synthetic peptide
  XENP023761 vhCDR3
DYYGSSPY

SEQ ID NO: 33709 - protein, 16 aa, Artificial Sequence
  Description of Artificial Sequence: Synthetic peptide
  XENP023761 vlCDR1
KSSQSIVHSNGNTYLE

SEQ ID NO: 33710 - protein, 7 aa, Artificial Sequence
  Description of Artificial Sequence: Synthetic peptide
  XENP023761 vlCDR2
KVSNRFS

SEQ ID NO: 33711 - protein, 9 aa, Artificial Sequence
  Description of Artificial Sequence: Synthetic peptide
  XENP023761 vlCDR3
FQGSHVPNT

SEQ ID NO: 33712 - protein, 251 aa, Artificial Sequence
  Description of Artificial Sequence: Synthetic polypeptide
  XENP023762 1C11_H3.11_L3_scFv
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33713 - protein, 117 aa, Artificial Sequence
  Description of Artificial Sequence: Synthetic polypeptide
  VH of XENP023762
QIQLVQSGSELKKPGASVKLSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33714 - protein, 114 aa, Artificial Sequence; identical to SEQ ID NO: 33651
  Description of Artificial Sequence: Synthetic polypeptide
  VL of XENP023762

SEQ ID NO: 33715 - protein, 5 aa, Artificial Sequence
  Description of Artificial Sequence: Synthetic peptide
  XENP023762 vhCDR1
HYGMN

SEQ ID NO: 33716 - protein, 17 aa, Artificial Sequence
  Description of Artificial Sequence: Synthetic peptide
  XENP023762 vhCDR2
WINTYTGEPTYADGFTG

SEQ ID NO: 33717 - protein, 8 aa, Artificial Sequence
  Description of Artificial Sequence: Synthetic peptide
  XENP023762 vhCDR3
DYYGSSPY

SEQ ID NO: 33718 - protein, 16 aa, Artificial Sequence
  Description of Artificial Sequence: Synthetic peptide
  XENP023762 vlCDR1
KSSQSIVHSNGNTYLE

SEQ ID NO: 33719 - protein, 7 aa, Artificial Sequence
  Description of Artificial Sequence: Synthetic peptide
  XENP023762 vlCDR2
KVSNRFS

SEQ ID NO: 33720 - protein, 9 aa, Artificial Sequence
  Description of Artificial Sequence: Synthetic peptide
  XENP023762 vlCDR3
FQGSHVPNT

SEQ ID NO: 33721 - protein, 251 aa, Artificial Sequence
  Description of Artificial Sequence: Synthetic polypeptide
  XENP023763 1C11_H3.12_L3_scFv
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33722 - protein, 117 aa, Artificial Sequence
  Description of Artificial Sequence: Synthetic polypeptide
  VH of XENP023763
QIQLVQSGSELKKPGASVKMSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33723 - protein, 114 aa, Artificial Sequence; identical to SEQ ID NO: 33651
  Description of Artificial Sequence: Synthetic polypeptide
  VL of XENP023763

SEQ ID NO: 33724 - protein, 5 aa, Artificial Sequence
  Description of Artificial Sequence: Synthetic peptide
  XENP023763 vhCDR1
HYGMN

SEQ ID NO: 33725 - protein, 17 aa, Artificial Sequence
  Description of Artificial Sequence: Synthetic peptide
  XENP023763 vhCDR2
WINTYTGEPTYADGFTG

SEQ ID NO: 33726 - protein, 8 aa, Artificial Sequence
  Description of Artificial Sequence: Synthetic peptide
  XENP023763 vhCDR3
DYYGSSPY

SEQ ID NO: 33727 - protein, 16 aa, Artificial Sequence
  Description of Artificial Sequence: Synthetic peptide
  XENP023763 vlCDR1
KSSQSIVHSNGNTYLE

SEQ ID NO: 33728 - protein, 7 aa, Artificial Sequence
  Description of Artificial Sequence: Synthetic peptide
  XENP023763 vlCDR2
KVSNRFS

SEQ ID NO: 33729 - protein, 9 aa, Artificial Sequence
  Description of Artificial Sequence: Synthetic peptide
  XENP023763 vlCDR3
FQGSHVPNT

SEQ ID NO: 33730 - protein, 251 aa, Artificial Sequence
  Description of Artificial Sequence: Synthetic polypeptide
  XENP023764 1C11_H3.16_L3_scFv
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33731 - protein, 117 aa, Artificial Sequence
  Description of Artificial Sequence: Synthetic polypeptide
  VH of XENP023764
QIQLVQSGSELKKPGASVKVSCKASGYTFTHYAMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 33732 - protein, 114 aa, Artificial Sequence; identical to SEQ ID NO: 33651
  Description of Artificial Sequence: Synthetic polypeptide
  VL of XENP023764

SEQ ID NO: 33733 - protein, 5 aa, Artificial Sequence
  Description of Artificial Sequence: Synthetic peptide
  XENP023764 vhCDR1
HYAMN

SEQ ID NO: 33734 - protein, 17 aa, Artificial Sequence
  Description of Artificial Sequence: Synthetic peptide
  XENP023764 vhCDR2
WINTYTGEPTYADGFTG

SEQ ID NO: 33735 - protein, 8 aa, Artificial Sequence
  Description of Artificial Sequence: Synthetic peptide
  XENP023764 vhCDR3
DYYGSSPY

SEQ ID NO: 33736 - protein, 16 aa, Artificial Sequence
  Description of Artificial Sequence: Synthetic peptide
  XENP023764 vlCDR1
KSSQSIVHSNGNTYLE

SEQ ID NO: 33737 - protein, 7 aa, Artificial Sequence
  Description of Artificial Sequence: Synthetic peptide
  XENP023764 vlCDR2
KVSNRFS

SEQ ID NO: 33738 - protein, 9 aa, Artificial Sequence
  Description of Artificial Sequence: Synthetic peptide
  XENP023764 vlCDR3
FQGSHVPNT

SEQ ID NO: 33739 - protein, 251 aa, Artificial Sequence
  Description of Artificial Sequence: Synthetic polypeptide
  XENP023765 1C11_H3.18_L3_scFv
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33740 - protein, 117 aa, Artificial Sequence
  Description of Artificial Sequence: Synthetic polypeptide
  VH of XENP023765
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSS

SEQ ID NO: 33741 - protein, 114 aa, Artificial Sequence; identical to SEQ ID NO: 33651
  Description of Artificial Sequence: Synthetic polypeptide
  VL of XENP023765

SEQ ID NO: 33742 - protein, 5 aa, Artificial Sequence
  Description of Artificial Sequence: Synthetic peptide
  XENP023765 vhCDR1
HYGMN

SEQ ID NO: 33743 - protein, 17 aa, Artificial Sequence
  Description of Artificial Sequence: Synthetic peptide
  XENP023765 vhCDR2
WINTYTGEPTYADGFTG

SEQ ID NO: 33744 - protein, 8 aa, Artificial Sequence
  Description of Artificial Sequence: Synthetic peptide
  XENP023765 vhCDR3
DYYGSSPY

SEQ ID NO: 33745 - protein, 16 aa, Artificial Sequence
  Description of Artificial Sequence: Synthetic peptide
  XENP023765 vlCDR1
KSSQSIVHSNGNTYLE

SEQ ID NO: 33746 - protein, 7 aa, Artificial Sequence
  Description of Artificial Sequence: Synthetic peptide
  XENP023765 vlCDR2
KVSNRFS

SEQ ID NO: 33747 - protein, 9 aa, Artificial Sequence
  Description of Artificial Sequence: Synthetic peptide
  XENP023765 vlCDR3
FQGSHVPNT

SEQ ID NO: 33748 - protein, 251 aa, Artificial Sequence
  Description of Artificial Sequence: Synthetic polypeptide
  XENP023766 1C11_H3.19_L3_scFv
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33749 - protein, 117 aa, Artificial Sequence
  Description of Artificial Sequence: Synthetic polypeptide
  VH of XENP023766
QIQLVQSGSELKKPGASVKVSCKASGYTFTHYGMNWVRQAPGKGLEWMGWINTYTGEPTYADGFTGRFVFSLDTSVSTAYLQISSLKAEDTAVYFCARDYYGSSPYWGQGTLVTVSS

SEQ ID NO: 33750 - protein, 114 aa, Artificial Sequence; identical to SEQ ID NO: 33651
  Description of Artificial Sequence: Synthetic polypeptide
  VL of XENP023766

SEQ ID NO: 33751 - protein, 5 aa, Artificial Sequence
  Description of Artificial Sequence: Synthetic peptide
  XENP023766 vhCDR1
HYGMN

SEQ ID NO: 33752 - protein, 17 aa, Artificial Sequence
  Description of Artificial Sequence: Synthetic peptide
  XENP023766 vhCDR2
WINTYTGEPTYADGFTG

SEQ ID NO: 33753 - protein, 8 aa, Artificial Sequence
  Description of Artificial Sequence: Synthetic peptide
  XENP023766 vhCDR3
DYYGSSPY

SEQ ID NO: 33754 - protein, 16 aa, Artificial Sequence
  Description of Artificial Sequence: Synthetic peptide
  XENP023766 vlCDR1
KSSQSIVHSNGNTYLE

SEQ ID NO: 33755 - protein, 7 aa, Artificial Sequence
  Description of Artificial Sequence: Synthetic peptide
  XENP023766 vlCDR2
KVSNRFS

SEQ ID NO: 33756 - protein, 9 aa, Artificial Sequence
  Description of Artificial Sequence: Synthetic peptide
  XENP023766 vlCDR3
FQGSHVPNT

SEQ ID NO: 33757 - protein, 251 aa, Artificial Sequence
  Description of Artificial Sequence: Synthetic polypeptide
  XENP023767 1C11_H3.20_L3_scFv
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33758 - protein, 117 aa, Artificial Sequence
  Description of Artificial Sequence: Synthetic polypeptide
  VH of XENP023767
QIQLVQSGSELKKPGASVKVSCKASGYTFTHYGMNWVRQAPGRGLEWMGWINTYTGEPTYADGFTGRFVFSLDTSVSTAYLQISSLKAEDTAVYFCARDYYGSSPYWGQGTLVTVSS

SEQ ID NO: 33759 - protein, 114 aa, Artificial Sequence; identical to SEQ ID NO: 33651
  Description of Artificial Sequence: Synthetic polypeptide
  VL of XENP023767

SEQ ID NO: 33760 - protein, 5 aa, Artificial Sequence
  Description of Artificial Sequence: Synthetic peptide
  XENP023767 vhCDR1
HYGMN

SEQ ID NO: 33761 - protein, 17 aa, Artificial Sequence
  Description of Artificial Sequence: Synthetic peptide
  XENP023767 vhCDR2
WINTYTGEPTYADGFTG

SEQ ID NO: 33762 - protein, 8 aa, Artificial Sequence
  Description of Artificial Sequence: Synthetic peptide
  XENP023767 vhCDR3
DYYGSSPY

SEQ ID NO: 33763 - protein, 16 aa, Artificial Sequence
  Description of Artificial Sequence: Synthetic peptide
  XENP023767 vlCDR1
KSSQSIVHSNGNTYLE

SEQ ID NO: 33764 - protein, 7 aa, Artificial Sequence
  Description of Artificial Sequence: Synthetic peptide
  XENP023767 vlCDR2
KVSNRFS

SEQ ID NO: 33765 - protein, 9 aa, Artificial Sequence
  Description of Artificial Sequence: Synthetic peptide
  XENP023767 vlCDR3
FQGSHVPNT

SEQ ID NO: 33766 - protein, 251 aa, Artificial Sequence
  Description of Artificial Sequence: Synthetic polypeptide
  XENP023768 1C11_H3.21_L3_scFv
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33767 - protein, 117 aa, Artificial Sequence
  Description of Artificial Sequence: Synthetic polypeptide
  VH of XENP023768
QIQLVQSGSELKKPGASVKVSCKASGYTFTHYGMNWVRQAPGHGLEWMGWINTYTGEPTYADGFTGRFVFSLDTSVSTAYLQISSLKAEDTAVYFCARDYYGSSPYWGQGTLVTVSS

SEQ ID NO: 33768 - protein, 114 aa, Artificial Sequence; identical to SEQ ID NO: 33651
  Description of Artificial Sequence: Synthetic polypeptide
  VL of XENP023768

SEQ ID NO: 33769 - protein, 5 aa, Artificial Sequence
  Description of Artificial Sequence: Synthetic peptide
  XENP023768 vhCDR1
HYGMN

SEQ ID NO: 33770 - protein, 17 aa, Artificial Sequence
  Description of Artificial Sequence: Synthetic peptide
  XENP023768 vhCDR2
WINTYTGEPTYADGFTG

SEQ ID NO: 33771 - protein, 8 aa, Artificial Sequence
  Description of Artificial Sequence: Synthetic peptide
  XENP023768 vhCDR3
DYYGSSPY

SEQ ID NO: 33772 - protein, 16 aa, Artificial Sequence
  Description of Artificial Sequence: Synthetic peptide
  XENP023768 vlCDR1
KSSQSIVHSNGNTYLE

SEQ ID NO: 33773 - protein, 7 aa, Artificial Sequence
  Description of Artificial Sequence: Synthetic peptide
  XENP023768 vlCDR2
KVSNRFS

SEQ ID NO: 33774 - protein, 9 aa, Artificial Sequence
  Description of Artificial Sequence: Synthetic peptide
  XENP023768 vlCDR3
FQGSHVPNT

SEQ ID NO: 33775 - protein, 251 aa, Artificial Sequence
  Description of Artificial Sequence: Synthetic polypeptide
  XENP023769 1C11_H3.22_L3_scFv
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33776 - protein, 117 aa, Artificial Sequence
  Description of Artificial Sequence: Synthetic polypeptide
  VH of XENP023769
QIQLVQSGSELKKPGASVKVSCKASGYTFTHYGMNWVRQAPGEGLEWMGWINTYTGEPTYADGFTGRFVFSLDTSVSTAYLQISSLKAEDTAVYFCARDYYGSSPYWGQGTLVTVSS

SEQ ID NO: 33777 - protein, 114 aa, Artificial Sequence; identical to SEQ ID NO: 33651
  Description of Artificial Sequence: Synthetic polypeptide
  VL of XENP023769

SEQ ID NO: 33778 - protein, 5 aa, Artificial Sequence
  Description of Artificial Sequence: Synthetic peptide
  XENP023769 vhCDR1
HYGMN

SEQ ID NO: 33779 - protein, 17 aa, Artificial Sequence
  Description of Artificial Sequence: Synthetic peptide
  XENP023769 vhCDR2
WINTYTGEPTYADGFTG

SEQ ID NO: 33780 - protein, 8 aa, Artificial Sequence
  Description of Artificial Sequence: Synthetic peptide
  XENP023769 vhCDR3
DYYGSSPY

SEQ ID NO: 33781 - protein, 16 aa, Artificial Sequence
  Description of Artificial Sequence: Synthetic peptide
  XENP023769 vlCDR1
KSSQSIVHSNGNTYLE

SEQ ID NO: 33782 - protein, 7 aa, Artificial Sequence
  Description of Artificial Sequence: Synthetic peptide
  XENP023769 vlCDR2
KVSNRFS

SEQ ID NO: 33783 - protein, 9 aa, Artificial Sequence
  Description of Artificial Sequence: Synthetic peptide
  XENP023769 vlCDR3
FQGSHVPNT

SEQ ID NO: 33784 - protein, 251 aa, Artificial Sequence
  Description of Artificial Sequence: Synthetic polypeptide
  XENP023770 1C11_H3.25_L3_scFv
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33785 - protein, 117 aa, Artificial Sequence
  Description of Artificial Sequence: Synthetic polypeptide
  VH of XENP023770
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSS

SEQ ID NO: 33786 - protein, 114 aa, Artificial Sequence; identical to SEQ ID NO: 33651
  Description of Artificial Sequence: Synthetic polypeptide
  VL of XENP023770

SEQ ID NO: 33787 - protein, 5 aa, Artificial Sequence
  Description of Artificial Sequence: Synthetic peptide
  XENP023770 vhCDR1
HYGMN

SEQ ID NO: 33788 - protein, 17 aa, Artificial Sequence
  Description of Artificial Sequence: Synthetic peptide
  XENP023770 vhCDR2
WINTNTGEPTYADGFTG

SEQ ID NO: 33789 - protein, 8 aa, Artificial Sequence
  Description of Artificial Sequence: Synthetic peptide
  XENP023770 vhCDR3
DYYGSSPY

SEQ ID NO: 33790 - protein, 16 aa, Artificial Sequence
  Description of Artificial Sequence: Synthetic peptide
  XENP023770 vlCDR1
KSSQSIVHSNGNTYLE

SEQ ID NO: 33791 - protein, 7 aa, Artificial Sequence
  Description of Artificial Sequence: Synthetic peptide
  XENP023770 vlCDR2
KVSNRFS

SEQ ID NO: 33792 - protein, 9 aa, Artificial Sequence
  Description of Artificial Sequence: Synthetic peptide
  XENP023770 vlCDR3
FQGSHVPNT

SEQ ID NO: 33793 - protein, 251 aa, Artificial Sequence
  Description of Artificial Sequence: Synthetic polypeptide
  XENP023771 1C11_H3.26_L3_scFv
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33794 - protein, 117 aa, Artificial Sequence
  Description of Artificial Sequence: Synthetic polypeptide
  VH of XENP023771
QIQLVQSGSELKKPGASVKVSCKASGYTFTHYGMNWVRQAPGQGLEWMGWINTYTGHPTYADGFTGRFVFSLDTSVSTAYLQISSLKAEDTAVYFCARDYYGSSPYWGQGTLVTVSS

SEQ ID NO: 33795 - protein, 114 aa, Artificial Sequence; identical to SEQ ID NO: 33651
  Description of Artificial Sequence: Synthetic polypeptide
  VL of XENP023771

SEQ ID NO: 33796 - protein, 5 aa, Artificial Sequence
  Description of Artificial Sequence: Synthetic peptide
  XENP023771 vhCDR1
HYGMN

SEQ ID NO: 33797 - protein, 17 aa, Artificial Sequence
  Description of Artificial Sequence: Synthetic peptide
  XENP023771 vhCDR2
WINTYTGHPTYADGFTG

SEQ ID NO: 33798 - protein, 8 aa, Artificial Sequence
  Description of Artificial Sequence: Synthetic peptide
  XENP023771 vhCDR3
DYYGSSPY

SEQ ID NO: 33799 - protein, 16 aa, Artificial Sequence
  Description of Artificial Sequence: Synthetic peptide
  XENP023771 vlCDR1
KSSQSIVHSNGNTYLE

SEQ ID NO: 33800 - protein, 7 aa, Artificial Sequence
  Description of Artificial Sequence: Synthetic peptide
  XENP023771 vlCDR2
KVSNRFS

SEQ ID NO: 33801 - protein, 9 aa, Artificial Sequence
  Description of Artificial Sequence: Synthetic peptide
  XENP023771 vlCDR3
FQGSHVPNT

SEQ ID NO: 33802 - protein, 251 aa, Artificial Sequence
  Description of Artificial Sequence: Synthetic polypeptide
  XENP023772 1C11_H3.30_L3_scFv
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33803 - protein, 117 aa, Artificial Sequence
  Description of Artificial Sequence: Synthetic polypeptide
  VH of XENP023772
QIQLVQSGSELKKPGASVKVSCKASGYTFTHYGMNWVRQAPGQGLEWMGWINTYTGEPEYADGFTGRFVFSLDTSVSTAYLQISSLKAEDTAVYFCARDYYGSSPYWGQGTLVTVSS

SEQ ID NO: 33804 - protein, 114 aa, Artificial Sequence; identical to SEQ ID NO: 33651
  Description of Artificial Sequence: Synthetic polypeptide
  VL of XENP023772

SEQ ID NO: 33805 - protein, 5 aa, Artificial Sequence
  Description of Artificial Sequence: Synthetic peptide
  XENP023772 vhCDR1
HYGMN

SEQ ID NO: 33806 - protein, 17 aa, Artificial Sequence
  Description of Artificial Sequence: Synthetic peptide
  XENP023772 vhCDR2
WINTYTGEPEYADGFTG

SEQ ID NO: 33807 - protein, 8 aa, Artificial Sequence
  Description of Artificial Sequence: Synthetic peptide
  XENP023772 vhCDR3
DYYGSSPY

SEQ ID NO: 33808 - protein, 16 aa, Artificial Sequence
  Description of Artificial Sequence: Synthetic peptide
  XENP023772 vlCDR1
KSSQSIVHSNGNTYLE

SEQ ID NO: 33809 - protein, 7 aa, Artificial Sequence
  Description of Artificial Sequence: Synthetic peptide
  XENP023772 vlCDR2
KVSNRFS

SEQ ID NO: 33810 - protein, 9 aa, Artificial Sequence
  Description of Artificial Sequence: Synthetic peptide
  XENP023772 vlCDR3
FQGSHVPNT

SEQ ID NO: 33811 - protein, 251 aa, Artificial Sequence
  Description of Artificial Sequence: Synthetic polypeptide
  XENP023773 1C11_H3.32_L3_scFv
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33812 - protein, 117 aa, Artificial Sequence
  Description of Artificial Sequence: Synthetic polypeptide
  VH of XENP023773
QIQLVQSGSELKKPGASVKVSCKASGYTFTHYGMNWVRQAPGQGLEWMGWINTYTGEPTYNDGFTGRFVFSLDTSVSTAYLQISSLKAEDTAVYFCARDYYGSSPYWGQGTLVTVSS

SEQ ID NO: 33813 - protein, 114 aa, Artificial Sequence; identical to SEQ ID NO: 33651
  Description of Artificial Sequence: Synthetic polypeptide
  VL of XENP023773

SEQ ID NO: 33814 - protein, 5 aa, Artificial Sequence
  Description of Artificial Sequence: Synthetic peptide
  XENP023773 vhCDR1
HYGMN

SEQ ID NO: 33815 - protein, 17 aa, Artificial Sequence
  Description of Artificial Sequence: Synthetic peptide
  XENP023773 vhCDR2
WINTYTGEPTYNDGFTG

SEQ ID NO: 33816 - protein, 8 aa, Artificial Sequence
  Description of Artificial Sequence: Synthetic peptide
  XENP023773 vhCDR3
DYYGSSPY

SEQ ID NO: 33817 - protein, 16 aa, Artificial Sequence
  Description of Artificial Sequence: Synthetic peptide
  XENP023773 vlCDR1
KSSQSIVHSNGNTYLE

SEQ ID NO: 33818 - protein, 7 aa, Artificial Sequence
  Description of Artificial Sequence: Synthetic peptide
  XENP023773 vlCDR2
KVSNRFS

SEQ ID NO: 33819 - protein, 9 aa, Artificial Sequence
  Description of Artificial Sequence: Synthetic peptide
  XENP023773 vlCDR3
FQGSHVPNT

SEQ ID NO: 33820 - protein, 251 aa, Artificial Sequence
  Description of Artificial Sequence: Synthetic polypeptide
  XENP023774 1C11_H3.33_L3_scFv
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33821 - protein, 117 aa, Artificial Sequence
  Description of Artificial Sequence: Synthetic polypeptide
  VH of XENP023774
QIQLVQSGSELKKPGASVKVSCKASGYTFTHYGMNWVRQAPGQGLEWMGWINTYTGEPTYAQGFTGRFVFSLDTSVSTAYLQISSLKAEDTAVYFCARDYYGSSPYWGQGTLVTVSS

SEQ ID NO: 33822 - protein, 114 aa, Artificial Sequence; identical to SEQ ID NO: 33651
  Description of Artificial Sequence: Synthetic polypeptide
  VL of XENP023774

SEQ ID NO: 33823 - protein, 5 aa, Artificial Sequence
  Description of Artificial Sequence: Synthetic peptide
  XENP023774 vhCDR1
HYGMN

SEQ ID NO: 33824 - protein, 17 aa, Artificial Sequence
  Description of Artificial Sequence: Synthetic peptide
  XENP023774 vhCDR2
WINTYTGEPTYAQGFTG

SEQ ID NO: 33825 - protein, 8 aa, Artificial Sequence
  Description of Artificial Sequence: Synthetic peptide
  XENP023774 vhCDR3
DYYGSSPY

SEQ ID NO: 33826 - protein, 16 aa, Artificial Sequence
  Description of Artificial Sequence: Synthetic peptide
  XENP023774 vlCDR1
KSSQSIVHSNGNTYLE

SEQ ID NO: 33827 - protein, 7 aa, Artificial Sequence
  Description of Artificial Sequence: Synthetic peptide
  XENP023774 vlCDR2
KVSNRFS

SEQ ID NO: 33828 - protein, 9 aa, Artificial Sequence
  Description of Artificial Sequence: Synthetic peptide
  XENP023774 vlCDR3
FQGSHVPNT

SEQ ID NO: 33829 - protein, 251 aa, Artificial Sequence
  Description of Artificial Sequence: Synthetic polypeptide
  XENP023775 1C11_H3.34_L3_scFv
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33830 - protein, 117 aa, Artificial Sequence
  Description of Artificial Sequence: Synthetic polypeptide
  VH of XENP023775
QIQLVQSGSELKKPGASVKVSCKASGYTFTHYGMNWVRQAPGQGLEWMGWINTYTGEPTYAEGFTGRFVFSLDTSVSTAYLQISSLKAEDTAVYFCARDYYGSSPYWGQGTLVTVSS

SEQ ID NO: 33831 - protein, 114 aa, Artificial Sequence; identical to SEQ ID NO: 33651
  Description of Artificial Sequence: Synthetic polypeptide
  VL of XENP023775

SEQ ID NO: 33832 - protein, 5 aa, Artificial Sequence
  Description of Artificial Sequence: Synthetic peptide
  XENP023775 vhCDR1
HYGMN

SEQ ID NO: 33833 - protein, 17 aa, Artificial Sequence
  Description of Artificial Sequence: Synthetic peptide
  XENP023775 vhCDR2
WINTYTGEPTYAEGFTG

SEQ ID NO: 33834 - protein, 8 aa, Artificial Sequence
  Description of Artificial Sequence: Synthetic peptide
  XENP023775 vhCDR3
DYYGSSPY

SEQ ID NO: 33835 - protein, 16 aa, Artificial Sequence
  Description of Artificial Sequence: Synthetic peptide
  XENP023775 vlCDR1
KSSQSIVHSNGNTYLE

SEQ ID NO: 33836 - protein, 7 aa, Artificial Sequence
  Description of Artificial Sequence: Synthetic peptide
  XENP023775 vlCDR2
KVSNRFS

SEQ ID NO: 33837 - protein, 9 aa, Artificial Sequence
  Description of Artificial Sequence: Synthetic peptide
  XENP023775 vlCDR3
FQGSHVPNT

SEQ ID NO: 33838 - protein, 251 aa, Artificial Sequence
  Description of Artificial Sequence: Synthetic polypeptide
  XENP023776 1C11_H3.35_L3_scFv
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33839 - protein, 117 aa, Artificial Sequence
  Description of Artificial Sequence: Synthetic polypeptide
  VH of XENP023776
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSS

SEQ ID NO: 33840 - protein, 114 aa, Artificial Sequence; identical to SEQ ID NO: 33651
  Description of Artificial Sequence: Synthetic polypeptide
  VL of XENP023776

SEQ ID NO: 33841 - protein, 5 aa, Artificial Sequence
  Description of Artificial Sequence: Synthetic peptide
  XENP023776 vhCDR1
HYGMN

SEQ ID NO: 33842 - protein, 17 aa, Artificial Sequence
  Description of Artificial Sequence: Synthetic peptide
  XENP023776 vhCDR2
WINTYTGEPTYADKFTG

SEQ ID NO: 33843 - protein, 8 aa, Artificial Sequence
  Description of Artificial Sequence: Synthetic peptide
  XENP023776 vhCDR3
DYYGSSPY

SEQ ID NO: 33844 - protein, 16 aa, Artificial Sequence
  Description of Artificial Sequence: Synthetic peptide
  XENP023776 vlCDR1
KSSQSIVHSNGNTYLE

SEQ ID NO: 33845 - protein, 7 aa, Artificial Sequence
  Description of Artificial Sequence: Synthetic peptide
  XENP023776 vlCDR2
KVSNRFS

SEQ ID NO: 33846 - protein, 9 aa, Artificial Sequence
  Description of Artificial Sequence: Synthetic peptide
  XENP023776 vlCDR3
FQGSHVPNT

SEQ ID NO: 33847 - protein, 251 aa, Artificial Sequence
  Description of Artificial Sequence: Synthetic polypeptide
  XENP023777 1C11_H3.38_L3_scFv
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33848 - protein, 117 aa, Artificial Sequence
  Description of Artificial Sequence: Synthetic polypeptide
  VH of XENP023777
QIQLVQSGSELKKPGASVKVSCKASGYTFTHYGMNWVRQAPGQGLEWMGWINTYTGEPTYADGITGRFVFSLDTSVSTAYLQISSLKAEDTAVYFCARDYYGSSPYWGQGTLVTVSS

SEQ ID NO: 33849 - protein, 114 aa, Artificial Sequence; identical to SEQ ID NO: 33651
  Description of Artificial Sequence: Synthetic polypeptide
  VL of XENP023777

SEQ ID NO: 33850 - protein, 5 aa, Artificial Sequence
  Description of Artificial Sequence: Synthetic peptide
  XENP023777 vhCDR1
HYGMN

SEQ ID NO: 33851 - protein, 17 aa, Artificial Sequence
  Description of Artificial Sequence: Synthetic peptide
  XENP023777 vhCDR2
WINTYTGEPTYADGITG

SEQ ID NO: 33852 - protein, 8 aa, Artificial Sequence
  Description of Artificial Sequence: Synthetic peptide
  XENP023777 vhCDR3
DYYGSSPY

SEQ ID NO: 33853 - protein, 16 aa, Artificial Sequence
  Description of Artificial Sequence: Synthetic peptide
  XENP023777 vlCDR1
KSSQSIVHSNGNTYLE

SEQ ID NO: 33854 - protein, 7 aa, Artificial Sequence
  Description of Artificial Sequence: Synthetic peptide
  XENP023777 vlCDR2
KVSNRFS

SEQ ID NO: 33855 - protein, 9 aa, Artificial Sequence
  Description of Artificial Sequence: Synthetic peptide
  XENP023777 vlCDR3
FQGSHVPNT

SEQ ID NO: 33856 - protein, 251 aa, Artificial Sequence
  Description of Artificial Sequence: Synthetic polypeptide
  XENP023778 1C11_H3.39_L3_scFv
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33857 - protein, 117 aa, Artificial Sequence
  Description of Artificial Sequence: Synthetic polypeptide
  VH of XENP023778
QIQLVQSGSELKKPGASVKVSCKASGYTFTHYGMNWVRQAPGQGLEWMGWINTYTGEPTYADGLTGRFVFSLDTSVSTAYLQISSLKAEDTAVYFCARDYYGSSPYWGQGTLVTVSS

SEQ ID NO: 33858 - protein, 114 aa, Artificial Sequence; identical to SEQ ID NO: 33651
  Description of Artificial Sequence: Synthetic polypeptide
  VL of XENP023778

SEQ ID NO: 33859 - protein, 5 aa, Artificial Sequence
  Description of Artificial Sequence: Synthetic peptide
  XENP023778 vhCDR1
HYGMN

SEQ ID NO: 33860 - protein, 17 aa, Artificial Sequence
  Description of Artificial Sequence: Synthetic peptide
  XENP023778 vhCDR2
WINTYTGEPTYADGLTG

SEQ ID NO: 33861 - protein, 8 aa, Artificial Sequence
  Description of Artificial Sequence: Synthetic peptide
  XENP023778 vhCDR3
DYYGSSPY

SEQ ID NO: 33862 - protein, 16 aa, Artificial Sequence
  Description of Artificial Sequence: Synthetic peptide
  XENP023778 vlCDR1
KSSQSIVHSNGNTYLE

SEQ ID NO: 33863 - protein, 7 aa, Artificial Sequence
  Description of Artificial Sequence: Synthetic peptide
  XENP023778 vlCDR2
KVSNRFS

SEQ ID NO: 33864 - protein, 9 aa, Artificial Sequence
  Description of Artificial Sequence: Synthetic peptide
  XENP023778 vlCDR3
FQGSHVPNT

SEQ ID NO: 33865 - protein, 251 aa, Artificial Sequence
  Description of Artificial Sequence: Synthetic polypeptide
  XENP023779 1C11_H3.41_L3_scFv
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33866 - protein, 117 aa, Artificial Sequence
  Description of Artificial Sequence: Synthetic polypeptide
  VH of XENP023779
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSS

SEQ ID NO: 33867 - protein, 114 aa, Artificial Sequence; identical to SEQ ID NO: 33651
  Description of Artificial Sequence: Synthetic polypeptide
  VL of XENP023779

SEQ ID NO: 33868 - protein, 5 aa, Artificial Sequence
  Description of Artificial Sequence: Synthetic peptide
  XENP023779 vhCDR1
HYGMN

SEQ ID NO: 33869 - protein, 17 aa, Artificial Sequence
  Description of Artificial Sequence: Synthetic peptide
  XENP023779 vhCDR2
WINTYTGEPTYADGFKG

SEQ ID NO: 33870 - protein, 8 aa, Artificial Sequence
  Description of Artificial Sequence: Synthetic peptide
  XENP023779 vhCDR3
DYYGSSPY

SEQ ID NO: 33871 - protein, 16 aa, Artificial Sequence
  Description of Artificial Sequence: Synthetic peptide
  XENP023779 vlCDR1
KSSQSIVHSNGNTYLE

SEQ ID NO: 33872 - protein, 7 aa, Artificial Sequence
  Description of Artificial Sequence: Synthetic peptide
  XENP023779 vlCDR2
KVSNRFS

SEQ ID NO: 33873 - protein, 9 aa, Artificial Sequence
  Description of Artificial Sequence: Synthetic peptide
  XENP023779 vlCDR3
FQGSHVPNT

SEQ ID NO: 33874 - protein, 251 aa, Artificial Sequence
  Description of Artificial Sequence: Synthetic polypeptide
  XENP023780 1C11_H3.42_L3_scFv
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33875 - protein, 117 aa, Artificial Sequence
  Description of Artificial Sequence: Synthetic polypeptide
  VH of XENP023780
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSS

SEQ ID NO: 33876 - protein, 114 aa, Artificial Sequence; identical to SEQ ID NO: 33651
  Description of Artificial Sequence: Synthetic polypeptide
  VL of XENP023780

SEQ ID NO: 33877 - protein, 5 aa, Artificial Sequence
  Description of Artificial Sequence: Synthetic peptide
  XENP023780 vhCDR1
HYGMN

SEQ ID NO: 33878 - protein, 17 aa, Artificial Sequence
  Description of Artificial Sequence: Synthetic peptide
  XENP023780 vhCDR2
WINTYTGEPTYADGFQG

SEQ ID NO: 33879 - protein, 8 aa, Artificial Sequence
  Description of Artificial Sequence: Synthetic peptide
  XENP023780 vhCDR3
DYYGSSPY

SEQ ID NO: 33880 - protein, 16 aa, Artificial Sequence
  Description of Artificial Sequence: Synthetic peptide
  XENP023780 vlCDR1
KSSQSIVHSNGNTYLE

SEQ ID NO: 33881 - protein, 7 aa, Artificial Sequence
  Description of Artificial Sequence: Synthetic peptide
  XENP023780 vlCDR2
KVSNRFS

SEQ ID NO: 33882 - protein, 9 aa, Artificial Sequence
  Description of Artificial Sequence: Synthetic peptide
  XENP023780 vlCDR3
FQGSHVPNT

SEQ ID NO: 33883 - protein, 251 aa, Artificial Sequence
  Description of Artificial Sequence: Synthetic polypeptide
  XENP023781 1C11_H3.43_L3_scFv
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33884 - protein, 117 aa, Artificial Sequence
  Description of Artificial Sequence: Synthetic polypeptide
  VH of XENP023781
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSS

SEQ ID NO: 33885 - protein, 114 aa, Artificial Sequence; identical to SEQ ID NO: 33651
  Description of Artificial Sequence: Synthetic polypeptide
  VL of XENP023781

SEQ ID NO: 33886 - protein, 5 aa, Artificial Sequence
  Description of Artificial Sequence: Synthetic peptide
  XENP023781 vhCDR1
HYGMN

SEQ ID NO: 33887 - protein, 17 aa, Artificial Sequence
  Description of Artificial Sequence: Synthetic peptide
  XENP023781 vhCDR2
WINTYTGEPTYADGFTG

SEQ ID NO: 33888 - protein, 8 aa, Artificial Sequence
  Description of Artificial Sequence: Synthetic peptide
  XENP023781 vhCDR3
DYYGSSPY

SEQ ID NO: 33889 - protein, 16 aa, Artificial Sequence
  Description of Artificial Sequence: Synthetic peptide
  XENP023781 vlCDR1
KSSQSIVHSNGNTYLE

SEQ ID NO: 33890 - protein, 7 aa, Artificial Sequence
  Description of Artificial Sequence: Synthetic peptide
  XENP023781 vlCDR2
KVSNRFS

SEQ ID NO: 33891 - protein, 9 aa, Artificial Sequence
  Description of Artificial Sequence: Synthetic peptide
  XENP023781 vlCDR3
FQGSHVPNT

SEQ ID NO: 33892 - protein, 251 aa, Artificial Sequence
  Description of Artificial Sequence: Synthetic polypeptide
  XENP023782 1C11_H3.44_L3_scFv
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33893 - protein, 117 aa, Artificial Sequence
  Description of Artificial Sequence: Synthetic polypeptide
  VH of XENP023782
QIQLVQSGSELKKPGASVKVSCKASGYTFTHYGMNWVRQAPGQGLEWMGWINTYTGEPTYADGFTGRFIFSLDTSVSTAYLQISSLKAEDTAVYFCARDYYGSSPYWGQGTLVTVSS

SEQ ID NO: 33894 - protein, 114 aa, Artificial Sequence; identical to SEQ ID NO: 33651
  Description of Artificial Sequence: Synthetic polypeptide
  VL of XENP023782

SEQ ID NO: 33895 - protein, 5 aa, Artificial Sequence
  Description of Artificial Sequence: Synthetic peptide
  XENP023782 vhCDR1
HYGMN

SEQ ID NO: 33896 - protein, 17 aa, Artificial Sequence
  Description of Artificial Sequence: Synthetic peptide
  XENP023782 vhCDR2
WINTYTGEPTYADGFTG

SEQ ID NO: 33897 - protein, 8 aa, Artificial Sequence
  Description of Artificial Sequence: Synthetic peptide
  XENP023782 vhCDR3
DYYGSSPY

SEQ ID NO: 33898 - protein, 16 aa, Artificial Sequence
  Description of Artificial Sequence: Synthetic peptide
  XENP023782 vlCDR1
KSSQSIVHSNGNTYLE

SEQ ID NO: 33899 - protein, 7 aa, Artificial Sequence
  Description of Artificial Sequence: Synthetic peptide
  XENP023782 vlCDR2
KVSNRFS

SEQ ID NO: 33900 - protein, 9 aa, Artificial Sequence
  Description of Artificial Sequence: Synthetic peptide
  XENP023782 vlCDR3
FQGSHVPNT

SEQ ID NO: 33901 - protein, 251 aa, Artificial Sequence
  Description of Artificial Sequence: Synthetic polypeptide
  XENP023783 1C11_H3.45_L3_scFv
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33902 - protein, 117 aa, Artificial Sequence
  Description of Artificial Sequence: Synthetic polypeptide
  VH of XENP023783
QIQLVQSGSELKKPGASVKVSCKASGYTFTHYGMNWVRQAPGQGLEWMGWINTYTGEPTYADGFTGRFSFSLDTSVSTAYLQISSLKAEDTAVYFCARDYYGSSPYWGQGTLVTVSS

SEQ ID NO: 33903 - protein, 114 aa, Artificial Sequence; identical to SEQ ID NO: 33651
  Description of Artificial Sequence: Synthetic polypeptide
  VL of XENP023783

SEQ ID NO: 33904 - protein, 5 aa, Artificial Sequence
  Description of Artificial Sequence: Synthetic peptide
  XENP023783 vhCDR1
HYGMN

SEQ ID NO: 33905 - protein, 17 aa, Artificial Sequence
  Description of Artificial Sequence: Synthetic peptide
  XENP023783 vhCDR2
WINTYTGEPTYADGFTG

SEQ ID NO: 33906 - protein, 8 aa, Artificial Sequence
  Description of Artificial Sequence: Synthetic peptide
  XENP023783 vhCDR3
DYYGSSPY

SEQ ID NO: 33907 - protein, 16 aa, Artificial Sequence
  Description of Artificial Sequence: Synthetic peptide
  XENP023783 vlCDR1
KSSQSIVHSNGNTYLE

SEQ ID NO: 33908 - protein, 7 aa, Artificial Sequence
  Description of Artificial Sequence: Synthetic peptide
  XENP023783 vlCDR2
KVSNRFS

SEQ ID NO: 33909 - protein, 9 aa, Artificial Sequence
  Description of Artificial Sequence: Synthetic peptide
  XENP023783 vlCDR3
FQGSHVPNT

SEQ ID NO: 33910 - protein, 251 aa, Artificial Sequence
  Description of Artificial Sequence: Synthetic polypeptide
  XENP023784 1C11_H3.46_L3_scFv
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33911 - protein, 117 aa, Artificial Sequence
  Description of Artificial Sequence: Synthetic polypeptide
  VH of XENP023784
QIQLVQSGSELKKPGASVKVSCKASGYTFTHYGMNWVRQAPGQGLEWMGWINTYTGEPTYADGFTGRFTFSLDTSVSTAYLQISSLKAEDTAVYFCARDYYGSSPYWGQGTLVTVSS

SEQ ID NO: 33912 - protein, 114 aa, Artificial Sequence; identical to SEQ ID NO: 33651
  Description of Artificial Sequence: Synthetic polypeptide
  VL of XENP023784

SEQ ID NO: 33913 - protein, 5 aa, Artificial Sequence
  Description of Artificial Sequence: Synthetic peptide
  XENP023784 vhCDR1
HYGMN

SEQ ID NO: 33914 - protein, 17 aa, Artificial Sequence
  Description of Artificial Sequence: Synthetic peptide
  XENP023784 vhCDR2
WINTYTGEPTYADGFTG

SEQ ID NO: 33915 - protein, 8 aa, Artificial Sequence
  Description of Artificial Sequence: Synthetic peptide
  XENP023784 vhCDR3
DYYGSSPY

SEQ ID NO: 33916 - protein, 16 aa, Artificial Sequence
  Description of Artificial Sequence: Synthetic peptide
  XENP023784 vlCDR1
KSSQSIVHSNGNTYLE

SEQ ID NO: 33917 - protein, 7 aa, Artificial Sequence
  Description of Artificial Sequence: Synthetic peptide
  XENP023784 vlCDR2
KVSNRFS

SEQ ID NO: 33918 - protein, 9 aa, Artificial Sequence
  Description of Artificial Sequence: Synthetic peptide
  XENP023784 vlCDR3
FQGSHVPNT

SEQ ID NO: 33919 - protein, 251 aa, Artificial Sequence
  Description of Artificial Sequence: Synthetic polypeptide
  XENP023785 1C11_H3.49_L3_scFv
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33920 - protein, 117 aa, Artificial Sequence
  Description of Artificial Sequence: Synthetic polypeptide
  VH of XENP023785
QIQLVQSGSELKKPGASVKVSCKASGYTFTHYGMNWVRQAPGQGLEWMGWINTYTGEPTYADGFTGRFVMSLDTSVSTAYLQISSLKAEDTAVYFCARDYYGSSPYWGQGTLVTVSS

SEQ ID NO: 33921 - protein, 114 aa, Artificial Sequence; identical to SEQ ID NO: 33651
  Description of Artificial Sequence: Synthetic polypeptide
  VL of XENP023785

SEQ ID NO: 33922 - protein, 5 aa, Artificial Sequence
  Description of Artificial Sequence: Synthetic peptide
  XENP023785 vhCDR1
HYGMN

SEQ ID NO: 33923 - protein, 17 aa, Artificial Sequence
  Description of Artificial Sequence: Synthetic peptide
  XENP023785 vhCDR2
WINTYTGEPTYADGFTG

SEQ ID NO: 33924 - protein, 8 aa, Artificial Sequence
  Description of Artificial Sequence: Synthetic peptide
  XENP023785 vhCDR3
DYYGSSPY

SEQ ID NO: 33925 - protein, 16 aa, Artificial Sequence
  Description of Artificial Sequence: Synthetic peptide
  XENP023785 vlCDR1
KSSQSIVHSNGNTYLE

SEQ ID NO: 33926 - protein, 7 aa, Artificial Sequence
  Description of Artificial Sequence: Synthetic peptide
  XENP023785 vlCDR2
KVSNRFS

SEQ ID NO: 33927 - protein, 9 aa, Artificial Sequence
  Description of Artificial Sequence: Synthetic peptide
  XENP023785 vlCDR3
FQGSHVPNT

SEQ ID NO: 33928 - protein, 251 aa, Artificial Sequence
  Description of Artificial Sequence: Synthetic polypeptide
  XENP023786 1C11_H3.50_L3_scFv
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33929 - protein, 117 aa, Artificial Sequence
  Description of Artificial Sequence: Synthetic polypeptide
  VH of XENP023786
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSS

SEQ ID NO: 33930 - protein, 114 aa, Artificial Sequence; identical to SEQ ID NO: 33651
  Description of Artificial Sequence: Synthetic polypeptide
  VL of XENP023786

SEQ ID NO: 33931 - protein, 5 aa, Artificial Sequence
  Description of Artificial Sequence: Synthetic peptide
  XENP023786 vhCDR1
HYGMN

SEQ ID NO: 33932 - protein, 17 aa, Artificial Sequence
  Description of Artificial Sequence: Synthetic peptide
  XENP023786 vhCDR2
WINTYTGEPTYADGFTG

SEQ ID NO: 33933 - protein, 8 aa, Artificial Sequence
  Description of Artificial Sequence: Synthetic peptide
  XENP023786 vhCDR3
DYYGSSPY

SEQ ID NO: 33934 - protein, 16 aa, Artificial Sequence
  Description of Artificial Sequence: Synthetic peptide
  XENP023786 vlCDR1
KSSQSIVHSNGNTYLE

SEQ ID NO: 33935 - protein, 7 aa, Artificial Sequence
  Description of Artificial Sequence: Synthetic peptide
  XENP023786 vlCDR2
KVSNRFS

SEQ ID NO: 33936 - protein, 9 aa, Artificial Sequence
  Description of Artificial Sequence: Synthetic peptide
  XENP023786 vlCDR3
FQGSHVPNT

SEQ ID NO: 33937 - protein, 251 aa, Artificial Sequence
  Description of Artificial Sequence: Synthetic polypeptide
  XENP023787 1C11_H3.51_L3_scFv
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33938 - protein, 117 aa, Artificial Sequence
  Description of Artificial Sequence: Synthetic polypeptide
  VH of XENP023787
QIQLVQSGSELKKPGASVKVSCKASGYTFTHYGMNWVRQAPGQGLEWMGWINTYTGEPTYADGFTGRFVFSVDTSVSTAYLQISSLKAEDTAVYFCARDYYGSSPYWGQGTLVTVSS

SEQ ID NO: 33939 - protein, 114 aa, Artificial Sequence; identical to SEQ ID NO: 33651
  Description of Artificial Sequence: Synthetic polypeptide
  VL of XENP023787

SEQ ID NO: 33940 - protein, 5 aa, Artificial Sequence
  Description of Artificial Sequence: Synthetic peptide
  XENP023787 vhCDR1
HYGMN

SEQ ID NO: 33941 - protein, 17 aa, Artificial Sequence
  Description of Artificial Sequence: Synthetic peptide
  XENP023787 vhCDR2
WINTYTGEPTYADGFTG

SEQ ID NO: 33942 - protein, 8 aa, Artificial Sequence
  Description of Artificial Sequence: Synthetic peptide
  XENP023787 vhCDR3
DYYGSSPY

SEQ ID NO: 33943 - protein, 16 aa, Artificial Sequence
  Description of Artificial Sequence: Synthetic peptide
  XENP023787 vlCDR1
KSSQSIVHSNGNTYLE

SEQ ID NO: 33944 - protein, 7 aa, Artificial Sequence
  Description of Artificial Sequence: Synthetic peptide
  XENP023787 vlCDR2
KVSNRFS

SEQ ID NO: 33945 - protein, 9 aa, Artificial Sequence
  Description of Artificial Sequence: Synthetic peptide
  XENP023787 vlCDR3
FQGSHVPNT

SEQ ID NO: 33946 - protein, 251 aa, Artificial Sequence
  Description of Artificial Sequence: Synthetic polypeptide
  XENP023788 1C11_H3.54_L3_scFv
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33947 - protein, 117 aa, Artificial Sequence
  Description of Artificial Sequence: Synthetic polypeptide
  VH of XENP023788
QIQLVQSGSELKKPGASVKVSCKASGYTFTHYGMNWVRQAPGQGLEWMGWINTYTGEPTYADGFTGRVTMTADTSVSTAYLQISSLKAEDTAVYFCARDYYGSSPYWGQGTLVTVSS

SEQ ID NO: 33948 - protein, 114 aa, Artificial Sequence; identical to SEQ ID NO: 33651
  Description of Artificial Sequence: Synthetic polypeptide
  VL of XENP023788

SEQ ID NO: 33949 - protein, 5 aa, Artificial Sequence
  Description of Artificial Sequence: Synthetic peptide
  XENP023788 vhCDR1
HYGMN

SEQ ID NO: 33950 - protein, 17 aa, Artificial Sequence
  Description of Artificial Sequence: Synthetic peptide
  XENP023788 vhCDR2
WINTYTGEPTYADGFTG

SEQ ID NO: 33951 - protein, 8 aa, Artificial Sequence
  Description of Artificial Sequence: Synthetic peptide
  XENP023788 vhCDR3
DYYGSSPY

SEQ ID NO: 33952 - protein, 16 aa, Artificial Sequence
  Description of Artificial Sequence: Synthetic peptide
  XENP023788 vlCDR1
KSSQSIVHSNGNTYLE

SEQ ID NO: 33953 - protein, 7 aa, Artificial Sequence
  Description of Artificial Sequence: Synthetic peptide
  XENP023788 vlCDR2
KVSNRFS

SEQ ID NO: 33954 - protein, 9 aa, Artificial Sequence
  Description of Artificial Sequence: Synthetic peptide
  XENP023788 vlCDR3
FQGSHVPNT

SEQ ID NO: 33955 - protein, 251 aa, Artificial Sequence
  Description of Artificial Sequence: Synthetic polypeptide
  XENP023789 1C11_H3.55_L3_scFv
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33956 - protein, 117 aa, Artificial Sequence
  Description of Artificial Sequence: Synthetic polypeptide
  VH of XENP023789
QIQLVQSGSELKKPGASVKVSCKASGYTFTHYGMNWVRQAPGQGLEWMGWINTYTGEPTYADGFTGRFVFSLDKSVSTAYLQISSLKAEDTAVYFCARDYYGSSPYWGQGTLVTVSS

SEQ ID NO: 33957 - protein, 114 aa, Artificial Sequence; identical to SEQ ID NO: 33651
  Description of Artificial Sequence: Synthetic polypeptide
  VL of XENP023789

SEQ ID NO: 33958 - protein, 5 aa, Artificial Sequence
  Description of Artificial Sequence: Synthetic peptide
  XENP023789 vhCDR1
HYGMN

SEQ ID NO: 33959 - protein, 17 aa, Artificial Sequence
  Description of Artificial Sequence: Synthetic peptide
  XENP023789 vhCDR2
WINTYTGEPTYADGFTG

SEQ ID NO: 33960 - protein, 8 aa, Artificial Sequence
  Description of Artificial Sequence: Synthetic peptide
  XENP023789 vhCDR3
DYYGSSPY

SEQ ID NO: 33961 - protein, 16 aa, Artificial Sequence
  Description of Artificial Sequence: Synthetic peptide
  XENP023789 vlCDR1
KSSQSIVHSNGNTYLE

SEQ ID NO: 33962 - protein, 7 aa, Artificial Sequence
  Description of Artificial Sequence: Synthetic peptide
  XENP023789 vlCDR2
KVSNRFS

SEQ ID NO: 33963 - protein, 9 aa, Artificial Sequence
  Description of Artificial Sequence: Synthetic peptide
  XENP023789 vlCDR3
FQGSHVPNT

SEQ ID NO: 33964 - protein, 251 aa, Artificial Sequence
  Description of Artificial Sequence: Synthetic polypeptide
  XENP023790 1C11_H3.56_L3_scFv
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33965 - protein, 117 aa, Artificial Sequence
  Description of Artificial Sequence: Synthetic polypeptide
  VH of XENP023790
QIQLVQSGSELKKPGASVKVSCKASGYTFTHYGMNWVRQAPGQGLEWMGWINTYTGEPTYADGFTGRFVFSLDTSASTAYLQISSLKAEDTAVYFCARDYYGSSPYWGQGTLVTVSS

SEQ ID NO: 33966 - protein, 114 aa, Artificial Sequence; identical to SEQ ID NO: 33651
  Description of Artificial Sequence: Synthetic polypeptide
  VL of XENP023790

SEQ ID NO: 33967 - protein, 5 aa, Artificial Sequence
  Description of Artificial Sequence: Synthetic peptide
  XENP023790 vhCDR1
HYGMN

SEQ ID NO: 33968 - protein, 17 aa, Artificial Sequence
  Description of Artificial Sequence: Synthetic peptide
  XENP023790 vhCDR2
WINTYTGEPTYADGFTG

SEQ ID NO: 33969 - protein, 8 aa, Artificial Sequence
  Description of Artificial Sequence: Synthetic peptide
  XENP023790 vhCDR3
DYYGSSPY

SEQ ID NO: 33970 - protein, 16 aa, Artificial Sequence
  Description of Artificial Sequence: Synthetic peptide
  XENP023790 vlCDR1
KSSQSIVHSNGNTYLE

SEQ ID NO: 33971 - protein, 7 aa, Artificial Sequence
  Description of Artificial Sequence: Synthetic peptide
  XENP023790 vlCDR2
KVSNRFS

SEQ ID NO: 33972 - protein, 9 aa, Artificial Sequence
  Description of Artificial Sequence: Synthetic peptide
  XENP023790 vlCDR3
FQGSHVPNT

SEQ ID NO: 33973 - protein, 251 aa, Artificial Sequence
  Description of Artificial Sequence: Synthetic polypeptide
  XENP023791 1C11_H3.57_L3_scFv
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33974 - protein, 117 aa, Artificial Sequence
  Description of Artificial Sequence: Synthetic polypeptide
  VH of XENP023791
QIQLVQSGSELKKPGASVKVSCKASGYTFTHYGMNWVRQAPGQGLEWMGWINTYTGEPTYADGFTGRFVFSLDTSISTAYLQISSLKAEDTAVYFCARDYYGSSPYWGQGTLVTVSS

SEQ ID NO: 33975 - protein, 114 aa, Artificial Sequence; identical to SEQ ID NO: 33651
  Description of Artificial Sequence: Synthetic polypeptide
  VL of XENP023791

SEQ ID NO: 33976 - protein, 5 aa, Artificial Sequence
  Description of Artificial Sequence: Synthetic peptide
  XENP023791 vhCDR1
HYGMN

SEQ ID NO: 33977 - protein, 17 aa, Artificial Sequence
  Description of Artificial Sequence: Synthetic peptide
  XENP023791 vhCDR2
WINTYTGEPTYADGFTG

SEQ ID NO: 33978 - protein, 8 aa, Artificial Sequence
  Description of Artificial Sequence: Synthetic peptide
  XENP023791 vhCDR3
DYYGSSPY

SEQ ID NO: 33979 - protein, 16 aa, Artificial Sequence
  Description of Artificial Sequence: Synthetic peptide
  XENP023791 vlCDR1
KSSQSIVHSNGNTYLE

SEQ ID NO: 33980 - protein, 7 aa, Artificial Sequence
  Description of Artificial Sequence: Synthetic peptide
  XENP023791 vlCDR2
KVSNRFS

SEQ ID NO: 33981 - protein, 9 aa, Artificial Sequence
  Description of Artificial Sequence: Synthetic peptide
  XENP023791 vlCDR3
FQGSHVPNT

SEQ ID NO: 33982 - protein, 251 aa, Artificial Sequence
  Description of Artificial Sequence: Synthetic polypeptide
  XENP023792 1C11_H3.58_L3_scFv
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33983 - protein, 117 aa, Artificial Sequence
  Description of Artificial Sequence: Synthetic polypeptide
  VH of XENP023792
QIQLVQSGSELKKPGASVKVSCKASGYTFTHYGMNWVRQAPGQGLEWMGWINTYTGEPTYADGFTGRFVFSLDTSKSTAYLQISSLKAEDTAVYFCARDYYGSSPYWGQGTLVTVSS

SEQ ID NO: 33984 - protein, 114 aa, Artificial Sequence; identical to SEQ ID NO: 33651
  Description of Artificial Sequence: Synthetic polypeptide
  VL of XENP023792

SEQ ID NO: 33985 - protein, 5 aa, Artificial Sequence
  Description of Artificial Sequence: Synthetic peptide
  XENP023792 vhCDR1
HYGMN

SEQ ID NO: 33986 - protein, 17 aa, Artificial Sequence
  Description of Artificial Sequence: Synthetic peptide
  XENP023792 vhCDR2
WINTYTGEPTYADGFTG

SEQ ID NO: 33987 - protein, 8 aa, Artificial Sequence
  Description of Artificial Sequence: Synthetic peptide
  XENP023792 vhCDR3
DYYGSSPY

SEQ ID NO: 33988 - protein, 16 aa, Artificial Sequence
  Description of Artificial Sequence: Synthetic peptide
  XENP023792 vlCDR1
KSSQSIVHSNGNTYLE

SEQ ID NO: 33989 - protein, 7 aa, Artificial Sequence
  Description of Artificial Sequence: Synthetic peptide
  XENP023792 vlCDR2
KVSNRFS

SEQ ID NO: 33990 - protein, 9 aa, Artificial Sequence
  Description of Artificial Sequence: Synthetic peptide
  XENP023792 vlCDR3
FQGSHVPNT

SEQ ID NO: 33991 - protein, 251 aa, Artificial Sequence
  Description of Artificial Sequence: Synthetic polypeptide
  XENP023793 1C11_H3.59_L3_scFv
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 33992 - protein, 117 aa, Artificial Sequence
  Description of Artificial Sequence: Synthetic polypeptide
  VH of XENP023793
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSS

SEQ ID NO: 33993 - protein, 114 aa, Artificial Sequence; identical to SEQ ID NO: 33651
  Description of Artificial Sequence: Synthetic polypeptide
  VL of XENP023793

SEQ ID NO: 33994 - protein, 5 aa, Artificial Sequence
  Description of Artificial Sequence: Synthetic peptide
  XENP023793 vhCDR1
HYGMN

SEQ ID NO: 33995 - protein, 17 aa, Artificial Sequence
  Description of Artificial Sequence: Synthetic peptide
  XENP023793 vhCDR2
WINTYTGEPTYADGFTG

SEQ ID NO: 33996 - protein, 8 aa, Artificial Sequence
  Description of Artificial Sequence: Synthetic peptide
  XENP023793 vhCDR3
DYYGSSPY

SEQ ID NO: 33997 - protein, 16 aa, Artificial Sequence
  Description of Artificial Sequence: Synthetic peptide
  XENP023793 vlCDR1
KSSQSIVHSNGNTYLE

SEQ ID NO: 33998 - protein, 7 aa, Artificial Sequence
  Description of Artificial Sequence: Synthetic peptide
  XENP023793 vlCDR2
KVSNRFS

SEQ ID NO: 33999 - protein, 9 aa, Artificial Sequence
  Description of Artificial Sequence: Synthetic peptide
  XENP023793 vlCDR3
FQGSHVPNT

SEQ ID NO: 34000 - protein, 251 aa, Artificial Sequence
  Description of Artificial Sequence: Synthetic polypeptide
  XENP023794 1C11_H3.60_L3_scFv
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34001 - protein, 117 aa, Artificial Sequence
  Description of Artificial Sequence: Synthetic polypeptide
  VH of XENP023794
QIQLVQSGSELKKPGASVKVSCKASGYTFTHYGMNWVRQAPGQGLEWMGWINTYTGEPTYADGFTGRFVFSLDTSTSTAYLQISSLKAEDTAVYFCARDYYGSSPYWGQGTLVTVSS

SEQ ID NO: 34002 - protein, 114 aa, Artificial Sequence; identical to SEQ ID NO: 33651
  Description of Artificial Sequence: Synthetic polypeptide
  VL of XENP023794

SEQ ID NO: 34003 - protein, 5 aa, Artificial Sequence
  Description of Artificial Sequence: Synthetic peptide
  XENP023794 vhCDR1
HYGMN

SEQ ID NO: 34004 - protein, 17 aa, Artificial Sequence
  Description of Artificial Sequence: Synthetic peptide
  XENP023794 vhCDR2
WINTYTGEPTYADGFTG

SEQ ID NO: 34005 - protein, 8 aa, Artificial Sequence
  Description of Artificial Sequence: Synthetic peptide
  XENP023794 vhCDR3
DYYGSSPY

SEQ ID NO: 34006 - protein, 16 aa, Artificial Sequence
  Description of Artificial Sequence: Synthetic peptide
  XENP023794 vlCDR1
KSSQSIVHSNGNTYLE

SEQ ID NO: 34007 - protein, 7 aa, Artificial Sequence
  Description of Artificial Sequence: Synthetic peptide
  XENP023794 vlCDR2
KVSNRFS

SEQ ID NO: 34008 - protein, 9 aa, Artificial Sequence
  Description of Artificial Sequence: Synthetic peptide
  XENP023794 vlCDR3
FQGSHVPNT

SEQ ID NO: 34009 - protein, 251 aa, Artificial Sequence
  Description of Artificial Sequence: Synthetic polypeptide
  XENP023795 1C11_H3.61_L3_scFv
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34010 - protein, 117 aa, Artificial Sequence
  Description of Artificial Sequence: Synthetic polypeptide
  VH of XENP023795
QIQLVQSGSELKKPGASVKVSCKASGYTFTHYGMNWVRQAPGQGLEWMGWINTYTGEPTYADGFTGRFVFSLDTSSSTAYLQISSLKAEDTAVYFCARDYYGSSPYWGQGTLVTVSS

SEQ ID NO: 34011 - protein, 114 aa, Artificial Sequence; identical to SEQ ID NO: 33651
  Description of Artificial Sequence: Synthetic polypeptide
  VL of XENP023795

SEQ ID NO: 34012 - protein, 5 aa, Artificial Sequence
  Description of Artificial Sequence: Synthetic peptide
  XENP023795 vhCDR1
HYGMN

SEQ ID NO: 34013 - protein, 17 aa, Artificial Sequence
  Description of Artificial Sequence: Synthetic peptide
  XENP023795 vhCDR2
WINTYTGEPTYADGFTG

SEQ ID NO: 34014 - protein, 8 aa, Artificial Sequence
  Description of Artificial Sequence: Synthetic peptide
  XENP023795 vhCDR3
DYYGSSPY

SEQ ID NO: 34015 - protein, 16 aa, Artificial Sequence
  Description of Artificial Sequence: Synthetic peptide
  XENP023795 vlCDR1
KSSQSIVHSNGNTYLE

SEQ ID NO: 34016 - protein, 7 aa, Artificial Sequence
  Description of Artificial Sequence: Synthetic peptide
  XENP023795 vlCDR2
KVSNRFS

SEQ ID NO: 34017 - protein, 9 aa, Artificial Sequence
  Description of Artificial Sequence: Synthetic peptide
  XENP023795 vlCDR3
FQGSHVPNT

SEQ ID NO: 34018 - protein, 251 aa, Artificial Sequence
  Description of Artificial Sequence: Synthetic polypeptide
  XENP023796 1C11_H3.62_L3_scFv
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34019 - protein, 117 aa, Artificial Sequence
  Description of Artificial Sequence: Synthetic polypeptide
  VH of XENP023796
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSS

SEQ ID NO: 34020 - protein, 114 aa, Artificial Sequence; identical to SEQ ID NO: 33651
  Description of Artificial Sequence: Synthetic polypeptide
  VL of XENP023796

SEQ ID NO: 34021 - protein, 5 aa, Artificial Sequence
  Description of Artificial Sequence: Synthetic peptide
  XENP023796 vhCDR1
HYGMN

SEQ ID NO: 34022 - protein, 17 aa, Artificial Sequence
  Description of Artificial Sequence: Synthetic peptide
  XENP023796 vhCDR2
WINTYTGEPTYADGFTG

SEQ ID NO: 34023 - protein, 8 aa, Artificial Sequence
  Description of Artificial Sequence: Synthetic peptide
  XENP023796 vhCDR3
DYYGSSPY

SEQ ID NO: 34024 - protein, 16 aa, Artificial Sequence
  Description of Artificial Sequence: Synthetic peptide
  XENP023796 vlCDR1
KSSQSIVHSNGNTYLE

SEQ ID NO: 34025 - protein, 7 aa, Artificial Sequence
  Description of Artificial Sequence: Synthetic peptide
  XENP023796 vlCDR2
KVSNRFS

SEQ ID NO: 34026 - protein, 9 aa, Artificial Sequence
  Description of Artificial Sequence: Synthetic peptide
  XENP023796 vlCDR3
FQGSHVPNT

SEQ ID NO: 34027 - protein, 251 aa, Artificial Sequence
  Description of Artificial Sequence: Synthetic polypeptide
  XENP023801 1C11_H3.64_L3_scFv
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34028 - protein, 117 aa, Artificial Sequence
  Description of Artificial Sequence: Synthetic polypeptide
  VH of XENP023801
QIQLVQSGSELKKPGASVKVSCKASGYTFTHYGMNWVRQAPGQGLEWMGWINTYTGEPTYADGFTGRFVFSLDTSVSTVYLQISSLKAEDTAVYFCARDYYGSSPYWGQGTLVTVSS

SEQ ID NO: 34029 - protein, 114 aa, Artificial Sequence; identical to SEQ ID NO: 33651
  Description of Artificial Sequence: Synthetic polypeptide
  VL of XENP023801

SEQ ID NO: 34030 - protein, 5 aa, Artificial Sequence
  Description of Artificial Sequence: Synthetic peptide
  XENP023801 vhCDR1
HYGMN

SEQ ID NO: 34031 - protein, 17 aa, Artificial Sequence
  Description of Artificial Sequence: Synthetic peptide
  XENP023801 vhCDR2
WINTYTGEPTYADGFTG

SEQ ID NO: 34032 - protein, 8 aa, Artificial Sequence
  Description of Artificial Sequence: Synthetic peptide
  XENP023801 vhCDR3
DYYGSSPY

SEQ ID NO: 34033 - protein, 16 aa, Artificial Sequence
  Description of Artificial Sequence: Synthetic peptide
  XENP023801 vlCDR1
KSSQSIVHSNGNTYLE

SEQ ID NO: 34034 - protein, 7 aa, Artificial Sequence
  Description of Artificial Sequence: Synthetic peptide
  XENP023801 vlCDR2
KVSNRFS

SEQ ID NO: 34035 - protein, 9 aa, Artificial Sequence
  Description of Artificial Sequence: Synthetic peptide
  XENP023801 vlCDR3
FQGSHVPNT

SEQ ID NO: 34036 - protein, 251 aa, Artificial Sequence
  Description of Artificial Sequence: Synthetic polypeptide
  XENP023802 1C11_H3.65_L3_scFv
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34037 - protein, 117 aa, Artificial Sequence
  Description of Artificial Sequence: Synthetic polypeptide
  VH of XENP023802
QIQLVQSGSELKKPGASVKVSCKASGYTFTHYGMNWVRQAPGQGLEWMGWINTYTGEPTYADGFTGRFVFSLDTSVSTAYMQISSLKAEDTAVYFCARDYYGSSPYWGQGTLVTVSS

SEQ ID NO: 34038 - protein, 114 aa, Artificial Sequence; identical to SEQ ID NO: 33651
  Description of Artificial Sequence: Synthetic polypeptide
  VL of XENP023802

SEQ ID NO: 34039 - protein, 5 aa, Artificial Sequence
  Description of Artificial Sequence: Synthetic peptide
  XENP023802 vhCDR1
HYGMN

SEQ ID NO: 34040 - protein, 17 aa, Artificial Sequence
  Description of Artificial Sequence: Synthetic peptide
  XENP023802 vhCDR2
WINTYTGEPTYADGFTG

SEQ ID NO: 34041 - protein, 8 aa, Artificial Sequence
  Description of Artificial Sequence: Synthetic peptide
  XENP023802 vhCDR3
DYYGSSPY

SEQ ID NO: 34042 - protein, 16 aa, Artificial Sequence
  Description of Artificial Sequence: Synthetic peptide
  XENP023802 vlCDR1
KSSQSIVHSNGNTYLE

SEQ ID NO: 34043 - protein, 7 aa, Artificial Sequence
  Description of Artificial Sequence: Synthetic peptide
  XENP023802 vlCDR2
KVSNRFS

SEQ ID NO: 34044 - protein, 9 aa, Artificial Sequence
  Description of Artificial Sequence: Synthetic peptide
  XENP023802 vlCDR3
FQGSHVPNT

SEQ ID NO: 34045 - protein, 251 aa, Artificial Sequence
  Description of Artificial Sequence: Synthetic polypeptide
  XENP023803 1C11_H3.66_L3_scFv
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34046 - protein, 117 aa, Artificial Sequence
  Description of Artificial Sequence: Synthetic polypeptide
  VH of XENP023803
QIQLVQSGSELKKPGASVKVSCKASGYTFTHYGMNWVRQAPGQGLEWMGWINTYTGEPTYADGFTGRFVFSLDTSVSTAYMELSSLKAEDTAVYFCARDYYGSSPYWGQGTLVTVSS

SEQ ID NO: 34047 - protein, 114 aa, Artificial Sequence; identical to SEQ ID NO: 33651
  Description of Artificial Sequence: Synthetic polypeptide
  VL of XENP023803

SEQ ID NO: 34048 - protein, 5 aa, Artificial Sequence
  Description of Artificial Sequence: Synthetic peptide
  XENP023803 vhCDR1
HYGMN

SEQ ID NO: 34049 - protein, 17 aa, Artificial Sequence
  Description of Artificial Sequence: Synthetic peptide
  XENP023803 vhCDR2
WINTYTGEPTYADGFTG

SEQ ID NO: 34050 - protein, 8 aa, Artificial Sequence
  Description of Artificial Sequence: Synthetic peptide
  XENP023803 vhCDR3
DYYGSSPY

SEQ ID NO: 34051 - protein, 16 aa, Artificial Sequence
  Description of Artificial Sequence: Synthetic peptide
  XENP023803 vlCDR1
KSSQSIVHSNGNTYLE

SEQ ID NO: 34052 - protein, 7 aa, Artificial Sequence
  Description of Artificial Sequence: Synthetic peptide
  XENP023803 vlCDR2
KVSNRFS

SEQ ID NO: 34053 - protein, 9 aa, Artificial Sequence
  Description of Artificial Sequence: Synthetic peptide
  XENP023803 vlCDR3
FQGSHVPNT

SEQ ID NO: 34054 - protein, 251 aa, Artificial Sequence
  Description of Artificial Sequence: Synthetic polypeptide
  XENP023804 1C11_H3.67_L3_scFv
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34055 - protein, 117 aa, Artificial Sequence
  Description of Artificial Sequence: Synthetic polypeptide
  VH of XENP023804
QIQLVQSGSELKKPGASVKVSCKASGYTFTHYGMNWVRQAPGQGLEWMGWINTYTGEPTYADGFTGRFVFSLDTSVSTAYLQLSSLKAEDTAVYFCARDYYGSSPYWGQGTLVTVSS

SEQ ID NO: 34056 - protein, 114 aa, Artificial Sequence; identical to SEQ ID NO: 33651
  Description of Artificial Sequence: Synthetic polypeptide
  VL of XENP023804

SEQ ID NO: 34057 - protein, 5 aa, Artificial Sequence
  Description of Artificial Sequence: Synthetic peptide
  XENP023804 vhCDR1
HYGMN

SEQ ID NO: 34058 - protein, 17 aa, Artificial Sequence
  Description of Artificial Sequence: Synthetic peptide
  XENP023804 vhCDR2
WINTYTGEPTYADGFTG

SEQ ID NO: 34059 - protein, 8 aa, Artificial Sequence
  Description of Artificial Sequence: Synthetic peptide
  XENP023804 vhCDR3
DYYGSSPY

SEQ ID NO: 34060 - protein, 16 aa, Artificial Sequence
  Description of Artificial Sequence: Synthetic peptide
  XENP023804 vlCDR1
KSSQSIVHSNGNTYLE

SEQ ID NO: 34061 - protein, 7 aa, Artificial Sequence
  Description of Artificial Sequence: Synthetic peptide
  XENP023804 vlCDR2
KVSNRFS

SEQ ID NO: 34062 - protein, 9 aa, Artificial Sequence
  Description of Artificial Sequence: Synthetic peptide
  XENP023804 vlCDR3
FQGSHVPNT

SEQ ID NO: 34063 - protein, 251 aa, Artificial Sequence
  Description of Artificial Sequence: Synthetic polypeptide
  XENP023805 1C11_H3.68_L3_scFv
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34064 - protein, 117 aa, Artificial Sequence
  Description of Artificial Sequence: Synthetic polypeptide
  VH of XENP023805
QIQLVQSGSELKKPGASVKVSCKASGYTFTHYGMNWVRQAPGQGLEWMGWINTYTGEPTYADGFTGRFVFSLDTSVSTAYLQMSSLKAEDTAVYFCARDYYGSSPYWGQGTLVTVSS

SEQ ID NO: 34065 - protein, 114 aa, Artificial Sequence; identical to SEQ ID NO: 33651
  Description of Artificial Sequence: Synthetic polypeptide
  VL of XENP023805

SEQ ID NO: 34066 - protein, 5 aa, Artificial Sequence
  Description of Artificial Sequence: Synthetic peptide
  XENP023805 vhCDR1
HYGMN

SEQ ID NO: 34067 - protein, 17 aa, Artificial Sequence
  Description of Artificial Sequence: Synthetic peptide
  XENP023805 vhCDR2
WINTYTGEPTYADGFTG

SEQ ID NO: 34068 - protein, 8 aa, Artificial Sequence
  Description of Artificial Sequence: Synthetic peptide
  XENP023805 vhCDR3
DYYGSSPY

SEQ ID NO: 34069 - protein, 16 aa, Artificial Sequence
  Description of Artificial Sequence: Synthetic peptide
  XENP023805 vlCDR1
KSSQSIVHSNGNTYLE

SEQ ID NO: 34070 - protein, 7 aa, Artificial Sequence
  Description of Artificial Sequence: Synthetic peptide
  XENP023805 vlCDR2
KVSNRFS

SEQ ID NO: 34071 - protein, 9 aa, Artificial Sequence
  Description of Artificial Sequence: Synthetic peptide
  XENP023805 vlCDR3
FQGSHVPNT

SEQ ID NO: 34072 - protein, 251 aa, Artificial Sequence
  Description of Artificial Sequence: Synthetic polypeptide
  XENP023806 1C11_H3.69_L3_scFv
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34073 - protein, 117 aa, Artificial Sequence
  Description of Artificial Sequence: Synthetic polypeptide
  VH of XENP023806
QIQLVQSGSELKKPGASVKVSCKASGYTFTHYGMNWVRQAPGQGLEWMGWINTYTGEPTYADGFTGRFVFSLDTSVSTAYLQWSSLKAEDTAVYFCARDYYGSSPYWGQGTLVTVSS

SEQ ID NO: 34074 - protein, 114 aa, Artificial Sequence; identical to SEQ ID NO: 33651
  Description of Artificial Sequence: Synthetic polypeptide
  VL of XENP023806

SEQ ID NO: 34075 - protein, 5 aa, Artificial Sequence
  Description of Artificial Sequence: Synthetic peptide
  XENP023806 vhCDR1
HYGMN

SEQ ID NO: 34076 - protein, 17 aa, Artificial Sequence
  Description of Artificial Sequence: Synthetic peptide
  XENP023806 vhCDR2
WINTYTGEPTYADGFTG

SEQ ID NO: 34077 - protein, 8 aa, Artificial Sequence
  Description of Artificial Sequence: Synthetic peptide
  XENP023806 vhCDR3
DYYGSSPY

SEQ ID NO: 34078 - protein, 16 aa, Artificial Sequence
  Description of Artificial Sequence: Synthetic peptide
  XENP023806 vlCDR1
KSSQSIVHSNGNTYLE

SEQ ID NO: 34079 - protein, 7 aa, Artificial Sequence
  Description of Artificial Sequence: Synthetic peptide
  XENP023806 vlCDR2
KVSNRFS

SEQ ID NO: 34080 - protein, 9 aa, Artificial Sequence
  Description of Artificial Sequence: Synthetic peptide
  XENP023806 vlCDR3
FQGSHVPNT

SEQ ID NO: 34081 - protein, 251 aa, Artificial Sequence
  Description of Artificial Sequence: Synthetic polypeptide
  XENP023807 1C11_H3.70_L3_scFv
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34082 - protein, 117 aa, Artificial Sequence
  Description of Artificial Sequence: Synthetic polypeptide
  VH of XENP023807
QIQLVQSGSELKKPGASVKVSCKASGYTFTHYGMNWVRQAPGQGLEWMGWINTYTGEPTYADGFTGRFVFSLDTSVSTAYLQVSSLKAEDTAVYFCARDYYGSSPYWGQGTLVTVSS

SEQ ID NO: 34083 - protein, 114 aa, Artificial Sequence; identical to SEQ ID NO: 33651
  Description of Artificial Sequence: Synthetic polypeptide
  VL of XENP023807

SEQ ID NO: 34084 - protein, 5 aa, Artificial Sequence
  Description of Artificial Sequence: Synthetic peptide
  XENP023807 vhCDR1
HYGMN

SEQ ID NO: 34085 - protein, 17 aa, Artificial Sequence
  Description of Artificial Sequence: Synthetic peptide
  XENP023807 vhCDR2
WINTYTGEPTYADGFTG

SEQ ID NO: 34086 - protein, 8 aa, Artificial Sequence
  Description of Artificial Sequence: Synthetic peptide
  XENP023807 vhCDR3
DYYGSSPY

SEQ ID NO: 34087 - protein, 16 aa, Artificial Sequence
  Description of Artificial Sequence: Synthetic peptide
  XENP023807 vlCDR1
KSSQSIVHSNGNTYLE

SEQ ID NO: 34088 - protein, 7 aa, Artificial Sequence
  Description of Artificial Sequence: Synthetic peptide
  XENP023807 vlCDR2
KVSNRFS

SEQ ID NO: 34089 - protein, 9 aa, Artificial Sequence
  Description of Artificial Sequence: Synthetic peptide
  XENP023807 vlCDR3
FQGSHVPNT

SEQ ID NO: 34090 - protein, 251 aa, Artificial Sequence
  Description of Artificial Sequence: Synthetic polypeptide
  XENP023808 1C11_H3.71_L3_scFv
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34091 - protein, 117 aa, Artificial Sequence
  Description of Artificial Sequence: Synthetic polypeptide
  VH of XENP023808
QIQLVQSGSELKKPGASVKVSCKASGYTFTHYGMNWVRQAPGQGLEWMGWINTYTGEPTYADGFTGRFVFSLDTSVSTAYLQISSLRAEDTAVYFCARDYYGSSPYWGQGTLVTVSS

SEQ ID NO: 34092 - protein, 114 aa, Artificial Sequence; identical to SEQ ID NO: 33651
  Description of Artificial Sequence: Synthetic polypeptide
  VL of XENP023808

SEQ ID NO: 34093 - protein, 5 aa, Artificial Sequence
  Description of Artificial Sequence: Synthetic peptide
  XENP023808 vhCDR1
HYGMN

SEQ ID NO: 34094 - protein, 17 aa, Artificial Sequence
  Description of Artificial Sequence: Synthetic peptide
  XENP023808 vhCDR2
WINTYTGEPTYADGFTG

SEQ ID NO: 34095 - protein, 8 aa, Artificial Sequence
  Description of Artificial Sequence: Synthetic peptide
  XENP023808 vhCDR3
DYYGSSPY

SEQ ID NO: 34096 - protein, 16 aa, Artificial Sequence
  Description of Artificial Sequence: Synthetic peptide
  XENP023808 vlCDR1
KSSQSIVHSNGNTYLE

SEQ ID NO: 34097 - protein, 7 aa, Artificial Sequence
  Description of Artificial Sequence: Synthetic peptide
  XENP023808 vlCDR2
KVSNRFS

SEQ ID NO: 34098 - protein, 9 aa, Artificial Sequence
  Description of Artificial Sequence: Synthetic peptide
  XENP023808 vlCDR3
FQGSHVPNT

SEQ ID NO: 34099 - protein, 251 aa, Artificial Sequence
  Description of Artificial Sequence: Synthetic polypeptide
  XENP023809 1C11_H3.72_L3_scFv
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34100 - protein, 117 aa, Artificial Sequence
  Description of Artificial Sequence: Synthetic polypeptide
  VH of XENP023809
QIQLVQSGSELKKPGASVKVSCKASGYTFTHYGMNWVRQAPGQGLEWMGWINTYTGEPTYADGFTGRFVFSLDTSVSTAYLQISSLTAEDTAVYFCARDYYGSSPYWGQGTLVTVSS

SEQ ID NO: 34101 - protein, 114 aa, Artificial Sequence; identical to SEQ ID NO: 33651
  Description of Artificial Sequence: Synthetic polypeptide
  VL of XENP023809

SEQ ID NO: 34102 - protein, 5 aa, Artificial Sequence
  Description of Artificial Sequence: Synthetic peptide
  XENP023809 vhCDR1
HYGMN

SEQ ID NO: 34103 - protein, 17 aa, Artificial Sequence
  Description of Artificial Sequence: Synthetic peptide
  XENP023809 vhCDR2
WINTYTGEPTYADGFTG

SEQ ID NO: 34104 - protein, 8 aa, Artificial Sequence
  Description of Artificial Sequence: Synthetic peptide
  XENP023809 vhCDR3
DYYGSSPY

SEQ ID NO: 34105 - protein, 16 aa, Artificial Sequence
  Description of Artificial Sequence: Synthetic peptide
  XENP023809 vlCDR1
KSSQSIVHSNGNTYLE

SEQ ID NO: 34106 - protein, 7 aa, Artificial Sequence
  Description of Artificial Sequence: Synthetic peptide
  XENP023809 vlCDR2
KVSNRFS

SEQ ID NO: 34107 - protein, 9 aa, Artificial Sequence
  Description of Artificial Sequence: Synthetic peptide
  XENP023809 vlCDR3
FQGSHVPNT

SEQ ID NO: 34108 - protein, 251 aa, Artificial Sequence
  Description of Artificial Sequence: Synthetic polypeptide
  XENP023810 1C11_H3.73_L3_scFv
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34109 - protein, 117 aa, Artificial Sequence
  Description of Artificial Sequence: Synthetic polypeptide
  VH of XENP023810
QIQLVQSGSELKKPGASVKVSCKASGYTFTHYGMNWVRQAPGQGLEWMGWINTYTGEPTYADGFTGRFVFSLDTSVSTAYLQISSLRSEDTAVYFCARDYYGSSPYWGQGTLVTVSS

SEQ ID NO: 34110 - protein, 114 aa, Artificial Sequence; identical to SEQ ID NO: 33651
  Description of Artificial Sequence: Synthetic polypeptide
  VL of XENP023810

SEQ ID NO: 34111 - protein, 5 aa, Artificial Sequence
  Description of Artificial Sequence: Synthetic peptide
  XENP023810 vhCDR1
HYGMN

SEQ ID NO: 34112 - protein, 17 aa, Artificial Sequence
  Description of Artificial Sequence: Synthetic peptide
  XENP023810 vhCDR2
WINTYTGEPTYADGFTG

SEQ ID NO: 34113 - protein, 8 aa, Artificial Sequence
  Description of Artificial Sequence: Synthetic peptide
  XENP023810 vhCDR3
DYYGSSPY

SEQ ID NO: 34114 - protein, 16 aa, Artificial Sequence
  Description of Artificial Sequence: Synthetic peptide
  XENP023810 vlCDR1
KSSQSIVHSNGNTYLE

SEQ ID NO: 34115 - protein, 7 aa, Artificial Sequence
  Description of Artificial Sequence: Synthetic peptide
  XENP023810 vlCDR2
KVSNRFS

SEQ ID NO: 34116 - protein, 9 aa, Artificial Sequence
  Description of Artificial Sequence: Synthetic peptide
  XENP023810 vlCDR3
FQGSHVPNT

SEQ ID NO: 34117 - protein, 251 aa, Artificial Sequence
  Description of Artificial Sequence: Synthetic polypeptide
  XENP023811 1C11_H3.74_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34118 - protein, 117 aa, Artificial Sequence
  Description of Artificial Sequence: Synthetic polypeptide
  VH of XENP023811
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSS

SEQ ID NO: 34119 - protein, 114 aa, Artificial Sequence; identical to SEQ ID NO: 33651
  Description of Artificial Sequence: Synthetic polypeptide
  VL of XENP023811

SEQ ID NO: 34120 - protein, 5 aa, Artificial Sequence
  Description of Artificial Sequence: Synthetic peptide
  XENP023811 vhCDR1
HYGMN

SEQ ID NO: 34121 - protein, 17 aa, Artificial Sequence
  Description of Artificial Sequence: Synthetic peptide
  XENP023811 vhCDR2
WINTYTGEPTYADGFTG

SEQ ID NO: 34122 - protein, 8 aa, Artificial Sequence
  Description of Artificial Sequence: Synthetic peptide
  XENP023811 vhCDR3
DYYGSSPY

SEQ ID NO: 34123 - protein, 16 aa, Artificial Sequence
  Description of Artificial Sequence: Synthetic peptide
  XENP023811 vlCDR1
KSSQSIVHSNGNTYLE

SEQ ID NO: 34124 - protein, 7 aa, Artificial Sequence
  Description of Artificial Sequence: Synthetic peptide
  XENP023811 vlCDR2
KVSNRFS

SEQ ID NO: 34125 - protein, 9 aa, Artificial Sequence
  Description of Artificial Sequence: Synthetic peptide
  XENP023811 vlCDR3
FQGSHVPNT

SEQ ID NO: 34126 - protein, 251 aa, Artificial Sequence
  Description of Artificial Sequence: Synthetic polypeptide
  XENP023812 1C11_H3.75_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34127 - protein, 117 aa, Artificial Sequence
  Description of Artificial Sequence: Synthetic polypeptide
  VH of XENP023812
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCTRDYYGSSPYWGQGTLVTVSS

SEQ ID NO: 34128 - protein, 114 aa, Artificial Sequence; identical to SEQ ID NO: 33651
  Description of Artificial Sequence: Synthetic polypeptide
  VL of XENP023812

SEQ ID NO: 34129 - protein, 5 aa, Artificial Sequence
  Description of Artificial Sequence: Synthetic peptide
  XENP023812 vhCDR1
HYGMN

SEQ ID NO: 34130 - protein, 17 aa, Artificial Sequence
  Description of Artificial Sequence: Synthetic peptide
  XENP023812 vhCDR2
WINTYTGEPTYADGFTG

SEQ ID NO: 34131 - protein, 8 aa, Artificial Sequence
  Description of Artificial Sequence: Synthetic peptide
  XENP023812 vhCDR3
DYYGSSPY

SEQ ID NO: 34132 - protein, 16 aa, Artificial Sequence
  Description of Artificial Sequence: Synthetic peptide
  XENP023812 vlCDR1
KSSQSIVHSNGNTYLE

SEQ ID NO: 34133 - protein, 7 aa, Artificial Sequence
  Description of Artificial Sequence: Synthetic peptide
  XENP023812 vlCDR2
KVSNRFS

SEQ ID NO: 34134 - protein, 9 aa, Artificial Sequence
  Description of Artificial Sequence: Synthetic peptide
  XENP023812 vlCDR3
FQGSHVPNT

SEQ ID NO: 34135 - protein, 251 aa, Artificial Sequence
  Description of Artificial Sequence: Synthetic polypeptide
  XENP024191 1C11_H3_L3.84_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 34136 - protein, 117 aa, Artificial Sequence; identical to SEQ ID NO: 33034
  Description of Artificial Sequence: Synthetic polypeptide
  VH of XENP024191

SEQ ID NO: 34137 - protein, 114 aa, Artificial Sequence
  Description of Artificial Sequence: Synthetic polypeptide
  VL of XENP024191
DVVMTQSPDSLAVSLGERATINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 34138 - protein, 5 aa, Artificial Sequence
  Description of Artificial Sequence: Synthetic peptide
  XENP024191 vhCDR1
HYGMN

SEQ ID NO: 34139 - protein, 17 aa, Artificial Sequence
  Description of Artificial Sequence: Synthetic peptide
  XENP024191 vhCDR2
WINTYTGEPTYADGFTG

SEQ ID NO: 34140 - protein, 8 aa, Artificial Sequence
  Description of Artificial Sequence: Synthetic peptide
  XENP024191 vhCDR3
DYYGSSPY

SEQ ID NO: 34141 - protein, 16 aa, Artificial Sequence
  Description of Artificial Sequence: Synthetic peptide
  XENP024191 vlCDR1
KASQSIVHSNGNTYLE

SEQ ID NO: 34142 - protein, 7 aa, Artificial Sequence
  Description of Artificial Sequence: Synthetic peptide
  XENP024191 vlCDR2
KVSNRFS

SEQ ID NO: 34143 - protein, 9 aa, Artificial Sequence
  Description of Artificial Sequence: Synthetic peptide
  XENP024191 vlCDR3
FQGSHVPNT

SEQ ID NO: 34144 - protein, 251 aa, Artificial Sequence
  Description of Artificial Sequence: Synthetic polypeptide
  XENP024192 1C11_H3_L3.102_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34145 - protein, 117 aa, Artificial Sequence; identical to SEQ ID NO: 33034
  Description of Artificial Sequence: Synthetic polypeptide
  VH of XENP024192

SEQ ID NO: 34146 - protein, 114 aa, Artificial Sequence
  Description of Artificial Sequence: Synthetic polypeptide
  VL of XENP024192
DVLMTQSPDSLAVSVGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34147 - protein, 5 aa, Artificial Sequence
  Description of Artificial Sequence: Synthetic peptide
  XENP024192 vhCDR1
HYGMN

SEQ ID NO: 34148 - protein, 17 aa, Artificial Sequence
  Description of Artificial Sequence: Synthetic peptide
  XENP024192 vhCDR2
WINTYTGEPTYADGFTG

SEQ ID NO: 34149 - protein, 8 aa, Artificial Sequence
  Description of Artificial Sequence: Synthetic peptide
  XENP024192 vhCDR3
DYYGSSPY

SEQ ID NO: 34150 - protein, 16 aa, Artificial Sequence
  Description of Artificial Sequence: Synthetic peptide
  XENP024192 vlCDR1
KSSQSIVHSNGNTYLE

SEQ ID NO: 34151 - protein, 7 aa, Artificial Sequence
  Description of Artificial Sequence: Synthetic peptide
  XENP024192 vlCDR2
KVSNRFS

SEQ ID NO: 34152 - protein, 9 aa, Artificial Sequence
  Description of Artificial Sequence: Synthetic peptide
  XENP024192 vlCDR3
FQGSHVPNT

SEQ ID NO: 34153 - protein, 251 aa, Artificial Sequence
  Description of Artificial Sequence: Synthetic polypeptide
  XENP024193 1C11_H3_L3.103_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34154 - protein, 117 aa, Artificial Sequence; identical to SEQ ID NO: 33034
  Description of Artificial Sequence: Synthetic polypeptide
  VH of XENP024193

SEQ ID NO: 34155 - protein, 114 aa, Artificial Sequence
  Description of Artificial Sequence: Synthetic polypeptide
  VL of XENP024193
DVLMTQSPDSLAVSPGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34156 - protein, 5 aa, Artificial Sequence
  Description of Artificial Sequence: Synthetic peptide
  XENP024193 vhCDR1
HYGMN

SEQ ID NO: 34157 - protein, 17 aa, Artificial Sequence
  Description of Artificial Sequence: Synthetic peptide
  XENP024193 vhCDR2
WINTYTGEPTYADGFTG

SEQ ID NO: 34158 - protein, 8 aa, Artificial Sequence
  Description of Artificial Sequence: Synthetic peptide
  XENP024193 vhCDR3
DYYGSSPY

SEQ ID NO: 34159 - protein, 16 aa, Artificial Sequence
  Description of Artificial Sequence: Synthetic peptide
  XENP024193 vlCDR1
KSSQSIVHSNGNTYLE

SEQ ID NO: 34160 - protein, 7 aa, Artificial Sequence
  Description of Artificial Sequence: Synthetic peptide
  XENP024193 vlCDR2
KVSNRFS

SEQ ID NO: 34161 - protein, 9 aa, Artificial Sequence
  Description of Artificial Sequence: Synthetic peptide
  XENP024193 vlCDR3
FQGSHVPNT

SEQ ID NO: 34162 - protein, 251 aa, Artificial Sequence; identical to SEQ ID NO: 33235
  Description of Artificial Sequence: Synthetic polypeptide
  XENP024194 1C11_H3_L3.104_scFv

SEQ ID NO: 34163 - protein, 117 aa, Artificial Sequence; identical to SEQ ID NO: 33034
  Description of Artificial Sequence: Synthetic polypeptide
  VH of XENP024194

SEQ ID NO: 34164 - protein, 114 aa, Artificial Sequence; identical to SEQ ID NO: 33237
  Description of Artificial Sequence: Synthetic polypeptide
  VL of XENP024194

SEQ ID NO: 34165 - protein, 5 aa, Artificial Sequence
  Description of Artificial Sequence: Synthetic peptide
  XENP024194 vhCDR1
HYGMN

SEQ ID NO: 34166 - protein, 17 aa, Artificial Sequence
  Description of Artificial Sequence: Synthetic peptide
  XENP024194 vhCDR2
WINTYTGEPTYADGFTG

SEQ ID NO: 34167 - protein, 8 aa, Artificial Sequence
  Description of Artificial Sequence: Synthetic peptide
  XENP024194 vhCDR3
DYYGSSPY

SEQ ID NO: 34168 - protein, 16 aa, Artificial Sequence
  Description of Artificial Sequence: Synthetic peptide
  XENP024194 vlCDR1
KSSQSIVHSNGNTYLE

SEQ ID NO: 34169 - protein, 7 aa, Artificial Sequence
  Description of Artificial Sequence: Synthetic peptide
  XENP024194 vlCDR2
KVSNRFS

SEQ ID NO: 34170 - protein, 9 aa, Artificial Sequence
  Description of Artificial Sequence: Synthetic peptide
  XENP024194 vlCDR3
FQGSHVPNT

SEQ ID NO: 34171 - protein, 251 aa, Artificial Sequence
  Description of Artificial Sequence: Synthetic polypeptide
  XENP024195 1C11_H3_L3.111_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34172 - protein, 117 aa, Artificial Sequence; identical to SEQ ID NO: 33034
  Description of Artificial Sequence: Synthetic polypeptide
  VH of XENP024195

SEQ ID NO: 34173 - protein, 114 aa, Artificial Sequence
  Description of Artificial Sequence: Synthetic polypeptide
  VL of XENP024195
DVLMTQSPDSLAVSLGERATINCKSSQGIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34174 - protein, 5 aa, Artificial Sequence
  Description of Artificial Sequence: Synthetic peptide
  XENP024195 vhCDR1
HYGMN

SEQ ID NO: 34175 - protein, 17 aa, Artificial Sequence
  Description of Artificial Sequence: Synthetic peptide
  XENP024195 vhCDR2
WINTYTGEPTYADGFTG

SEQ ID NO: 34176 - protein, 8 aa, Artificial Sequence
  Description of Artificial Sequence: Synthetic peptide
  XENP024195 vhCDR3
DYYGSSPY

SEQ ID NO: 34177 - protein, 16 aa, Artificial Sequence
  Description of Artificial Sequence: Synthetic peptide
  XENP024195 vlCDR1
KSSQGIVHSNGNTYLE

SEQ ID NO: 34178 - protein, 7 aa, Artificial Sequence
  Description of Artificial Sequence: Synthetic peptide
  XENP024195 vlCDR2
KVSNRFS

SEQ ID NO: 34179 - protein, 9 aa, Artificial Sequence
  Description of Artificial Sequence: Synthetic peptide
  XENP024195 vlCDR3
FQGSHVPNT

SEQ ID NO: 34180 - protein, 251 aa, Artificial Sequence
  Description of Artificial Sequence: Synthetic polypeptide
  XENP024196 1C11_H3_L3.112_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34181 - protein, 117 aa, Artificial Sequence; identical to SEQ ID NO: 33034
  Description of Artificial Sequence: Synthetic polypeptide
  VH of XENP024196

SEQ ID NO: 34182 - protein, 114 aa, Artificial Sequence
  Description of Artificial Sequence: Synthetic polypeptide
  VL of XENP024196
DVLMTQSPDSLAVSLGERATINCKSSQSVLHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34183 - protein, 5 aa, Artificial Sequence
  Description of Artificial Sequence: Synthetic peptide
  XENP024196 vhCDR1
HYGMN

SEQ ID NO: 34184 - protein, 17 aa, Artificial Sequence
  Description of Artificial Sequence: Synthetic peptide
  XENP024196 vhCDR2
WINTYTGEPTYADGFTG

SEQ ID NO: 34185 - protein, 8 aa, Artificial Sequence
  Description of Artificial Sequence: Synthetic peptide
  XENP024196 vhCDR3
DYYGSSPY

SEQ ID NO: 34186 - protein, 16 aa, Artificial Sequence
  Description of Artificial Sequence: Synthetic peptide
  XENP024196 vlCDR1
KSSQSVLHSNGNTYLE

SEQ ID NO: 34187 - protein, 7 aa, Artificial Sequence
  Description of Artificial Sequence: Synthetic peptide
  XENP024196 vlCDR2
KVSNRFS

SEQ ID NO: 34188 - protein, 9 aa, Artificial Sequence
  Description of Artificial Sequence: Synthetic peptide
  XENP024196 vlCDR3
FQGSHVPNT

SEQ ID NO: 34189 - protein, 251 aa, Artificial Sequence
  Description of Artificial Sequence: Synthetic polypeptide
  XENP024201 1C11_H3_L3.113_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 34190 - protein, 117 aa, Artificial Sequence; identical to SEQ ID NO: 33034
  Description of Artificial Sequence: Synthetic polypeptide
  VH of XENP024201

SEQ ID NO: 34191 - protein, 114 aa, Artificial Sequence
  Description of Artificial Sequence: Synthetic polypeptide
  VL of XENP024201
DVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIKGS

SEQ ID NO: 34192 - protein, 5 aa, Artificial Sequence
  Description of Artificial Sequence: Synthetic peptide
  XENP024201 vhCDR1
HYGMN

SEQ ID NO: 34193 - protein, 17 aa, Artificial Sequence
  Description of Artificial Sequence: Synthetic peptide
  XENP024201 vhCDR2
WINTYTGEPTYADGFTG

SEQ ID NO: 34194 - protein, 8 aa, Artificial Sequence
  Description of Artificial Sequence: Synthetic peptide
  XENP024201 vhCDR3
DYYGSSPY

SEQ ID NO: 34195 - protein, 16 aa, Artificial Sequence
  Description of Artificial Sequence: Synthetic peptide
  XENP024201 vlCDR1
KSSQSIVHSNGNTYLE

SEQ ID NO: 34196 - protein, 7 aa, Artificial Sequence
  Description of Artificial Sequence: Synthetic peptide
  XENP024201 vlCDR2
KVSNRFS

SEQ ID NO: 34197 - protein, 9 aa, Artificial Sequence
  Description of Artificial Sequence: Synthetic peptide
  XENP024201 vlCDR3
FQGSHVPNT

SEQ ID NO: 34198 - protein, 251 aa, Artificial Sequence
  Description of Artificial Sequence: Synthetic polypeptide
  XENP024202 1C11_H3_L3.115_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 34199 - protein, 117 aa, Artificial Sequence; identical to SEQ ID NO: 33034
  Description of Artificial Sequence: Synthetic polypeptide
  VH of XENP024202

SEQ ID NO: 34200 - protein, 114 aa, Artificial Sequence
  Description of Artificial Sequence: Synthetic polypeptide
  VL of XENP024202
DVLMTQSPDSLAVSLGERATINCKSSQSIVHSNGNTYLEWYQQKPGKVPKLLIYKVSNRFSGVPDRFSGSGSGTDFTLTISSLQAEDVAVYYCFQGSHVPNTFGGGTKVEIKGS

SEQ ID NO: 34201 - protein, 5 aa, Artificial Sequence
  Description of Artificial Sequence: Synthetic peptide
  XENP024202 vhCDR1
HYGMN

SEQ ID NO: 34202 - protein, 17 aa, Artificial Sequence
  Description of Artificial Sequence: Synthetic peptide
  XENP024202 vhCDR2
WINTYTGEPTYADGFTG

SEQ ID NO: 34203 - protein, 8 aa, Artificial Sequence
  Description of Artificial Sequence: Synthetic peptide
  XENP024202 vhCDR3
DYYGSSPY

SEQ ID NO: 34204 - protein, 16 aa, Artificial Sequence
  Description of Artificial Sequence: Synthetic peptide
  XENP024202 vlCDR1
KSSQSIVHSNGNTYLE

SEQ ID NO: 34205 - protein, 7 aa, Artificial Sequence
  Description of Artificial Sequence: Synthetic peptide
  XENP024202 vlCDR2
KVSNRFS

SEQ ID NO: 34206 - protein, 9 aa, Artificial Sequence
  Description of Artificial Sequence: Synthetic peptide
  XENP024202 vlCDR3
FQGSHVPNT

SEQ ID NO: 34207 - protein, 251 aa, Artificial Sequence
  Description of Artificial Sequence: Synthetic polypeptide
  XENP024203 1C11_H3_L3.118_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 34208 - protein, 117 aa, Artificial Sequence; identical to SEQ ID NO: 33034
  Description of Artificial Sequence: Synthetic polypeptide
  VH of XENP024203

SEQ ID NO: 34209 - protein, 114 aa, Artificial Sequence
  Description of Artificial Sequence: Synthetic polypeptide
  VL of XENP024203
DVLMTQSPDSLAVSLGERATINCKSSQSIVHSNGNTYLEWYQQKPGQSPKLLIYKVSSRFSGVPDRFSGSGSGTDFTLTISSLQAEDVAVYYCFQGSHVPNTFGGGTKVEIKGS

SEQ ID NO: 34210 - protein, 5 aa, Artificial Sequence
  Description of Artificial Sequence: Synthetic peptide
  XENP024203 vhCDR1
HYGMN

SEQ ID NO: 34211 - protein, 17 aa, Artificial Sequence
  Description of Artificial Sequence: Synthetic peptide
  XENP024203 vhCDR2
WINTYTGEPTYADGFTG

SEQ ID NO: 34212 - protein, 8 aa, Artificial Sequence
  Description of Artificial Sequence: Synthetic peptide
  XENP024203 vhCDR3
DYYGSSPY

SEQ ID NO: 34213 - protein, 16 aa, Artificial Sequence
  Description of Artificial Sequence: Synthetic peptide
  XENP024203 vlCDR1
KSSQSIVHSNGNTYLE

SEQ ID NO: 34214 - protein, 7 aa, Artificial Sequence
  Description of Artificial Sequence: Synthetic peptide
  XENP024203 vlCDR2
KVSSRFS

SEQ ID NO: 34215 - protein, 9 aa, Artificial Sequence
  Description of Artificial Sequence: Synthetic peptide
  XENP024203 vlCDR3
FQGSHVPNT

SEQ ID NO: 34216 - protein, 251 aa, Artificial Sequence
  Description of Artificial Sequence: Synthetic polypeptide
  XENP024204 1C11_H3_L3.119_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 34217 - protein, 117 aa, Artificial Sequence; identical to SEQ ID NO: 33034
  Description of Artificial Sequence: Synthetic polypeptide
  VH of XENP024204

SEQ ID NO: 34218 - protein, 114 aa, Artificial Sequence
  Description of Artificial Sequence: Synthetic polypeptide
  VL of XENP024204
DVLMTQSPDSLAVSLGERATINCKSSQSIVHSNGNTYLEWYQQKPGQSPKLLIYKVSNLFSGVPDRFSGSGSGTDFTLTISSLQAEDVAVYYCFQGSHVPNTFGGGTKVEIKGS

SEQ ID NO: 34219 - protein, 5 aa, Artificial Sequence
  Description of Artificial Sequence: Synthetic peptide
  XENP024204 vhCDR1
HYGMN

SEQ ID NO: 34220 - protein, 17 aa, Artificial Sequence
  Description of Artificial Sequence: Synthetic peptide
  XENP024204 vhCDR2
WINTYTGEPTYADGFTG

SEQ ID NO: 34221 - protein, 8 aa, Artificial Sequence
  Description of Artificial Sequence: Synthetic peptide
  XENP024204 vhCDR3
DYYGSSPY

SEQ ID NO: 34222 - protein, 16 aa, Artificial Sequence
  Description of Artificial Sequence: Synthetic peptide
  XENP024204 vlCDR1
KSSQSIVHSNGNTYLE

SEQ ID NO: 34223 - protein, 7 aa, Artificial Sequence
  Description of Artificial Sequence: Synthetic peptide
  XENP024204 vlCDR2
KVSNLFS

SEQ ID NO: 34224 - protein, 9 aa, Artificial Sequence
  Description of Artificial Sequence: Synthetic peptide
  XENP024204 vlCDR3
FQGSHVPNT

SEQ ID NO: 34225 - protein, 251 aa, Artificial Sequence
  Description of Artificial Sequence: Synthetic polypeptide
  XENP024205 1C11_H3_L3.120_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 34226 - protein, 117 aa, Artificial Sequence; identical to SEQ ID NO: 33034
  Description of Artificial Sequence: Synthetic polypeptide
  VH of XENP024205

SEQ ID NO: 34227 - protein, 114 aa, Artificial Sequence
  Description of Artificial Sequence: Synthetic polypeptide
  VL of XENP024205
DVLMTQSPDSLAVSLGERATINCKSSQSIVHSNGNTYLEWYQQKPGQSPKLLIYKVSNRESGVPDRFSGSGSGTDFTLTISSLQAEDVAVYYCFQGSHVPNTFGGGTKVEIKGS

SEQ ID NO: 34228 - protein, 5 aa, Artificial Sequence
  Description of Artificial Sequence: Synthetic peptide
  XENP024205 vhCDR1
HYGMN

SEQ ID NO: 34229 - protein, 17 aa, Artificial Sequence
  Description of Artificial Sequence: Synthetic peptide
  XENP024205 vhCDR2
WINTYTGEPTYADGFTG

SEQ ID NO: 34230 - protein, 8 aa, Artificial Sequence
  Description of Artificial Sequence: Synthetic peptide
  XENP024205 vhCDR3
DYYGSSPY

SEQ ID NO: 34231 - protein, 16 aa, Artificial Sequence
  Description of Artificial Sequence: Synthetic peptide
  XENP024205 vlCDR1
KSSQSIVHSNGNTYLE

SEQ ID NO: 34232 - protein, 7 aa, Artificial Sequence
  Description of Artificial Sequence: Synthetic peptide
  XENP024205 vlCDR2
KVSNRES

SEQ ID NO: 34233 - protein, 9 aa, Artificial Sequence
  Description of Artificial Sequence: Synthetic peptide
  XENP024205 vlCDR3
FQGSHVPNT

SEQ ID NO: 34234 - protein, 251 aa, Artificial Sequence
  Description of Artificial Sequence: Synthetic polypeptide
  XENP024206 1C11_H3_L3.121_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 34235 - protein, 117 aa, Artificial Sequence; identical to SEQ ID NO: 33034
  Description of Artificial Sequence: Synthetic polypeptide
  VH of XENP024206

SEQ ID NO: 34236 - protein, 114 aa, Artificial Sequence
  Description of Artificial Sequence: Synthetic polypeptide
  VL of XENP024206
DVLMTQSPDSLAVSLGERATINCKSSQSIVHSNGNTYLEWYQQKPGQSPKLLIYKVSNRQSGVPDRFSGSGSGTDFTLTISSLQAEDVAVYYCFQGSHVPNTFGGGTKVEIKGS

SEQ ID NO: 34237 - protein, 5 aa, Artificial Sequence
  Description of Artificial Sequence: Synthetic peptide
  XENP024206 vhCDR1
HYGMN

SEQ ID NO: 34238 - protein, 17 aa, Artificial Sequence
  Description of Artificial Sequence: Synthetic peptide
  XENP024206 vhCDR2
WINTYTGEPTYADGFTG

SEQ ID NO: 34239 - protein, 8 aa, Artificial Sequence
  Description of Artificial Sequence: Synthetic peptide
  XENP024206 vhCDR3
DYYGSSPY

SEQ ID NO: 34240 - protein, 16 aa, Artificial Sequence
  Description of Artificial Sequence: Synthetic peptide
  XENP024206 vlCDR1
KSSQSIVHSNGNTYLE

SEQ ID NO: 34241 - protein, 7 aa, Artificial Sequence
  Description of Artificial Sequence: Synthetic peptide
  XENP024206 vlCDR2
KVSNRQS

SEQ ID NO: 34242 - protein, 9 aa, Artificial Sequence
  Description of Artificial Sequence: Synthetic peptide
  XENP024206 vlCDR3
FQGSHVPNT

SEQ ID NO: 34243 - protein, 251 aa, Artificial Sequence
  Description of Artificial Sequence: Synthetic polypeptide
  XENP024207 1C11_H3_L3.122_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 34244 - protein, 117 aa, Artificial Sequence; identical to SEQ ID NO: 33034
  Description of Artificial Sequence: Synthetic polypeptide
  VH of XENP024207

SEQ ID NO: 34245 - protein, 114 aa, Artificial Sequence
  Description of Artificial Sequence: Synthetic polypeptide
  VL of XENP024207
DVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIKGS

SEQ ID NO: 34246 - protein, 5 aa, Artificial Sequence
  Description of Artificial Sequence: Synthetic peptide
  XENP024207 vhCDR1
HYGMN

SEQ ID NO: 34247 - protein, 17 aa, Artificial Sequence
  Description of Artificial Sequence: Synthetic peptide
  XENP024207 vhCDR2
WINTYTGEPTYADGFTG

SEQ ID NO: 34248 - protein, 8 aa, Artificial Sequence
  Description of Artificial Sequence: Synthetic peptide
  XENP024207 vhCDR3
DYYGSSPY

SEQ ID NO: 34249 - protein, 16 aa, Artificial Sequence
  Description of Artificial Sequence: Synthetic peptide
  XENP024207 vlCDR1
KSSQSIVHSNGNTYLE

SEQ ID NO: 34250 - protein, 7 aa, Artificial Sequence
  Description of Artificial Sequence: Synthetic peptide
  XENP024207 vlCDR2
KVSNRFS

SEQ ID NO: 34251 - protein, 9 aa, Artificial Sequence
  Description of Artificial Sequence: Synthetic peptide
  XENP024207 vlCDR3
FQGSHVPNT

SEQ ID NO: 34252 - protein, 251 aa, Artificial Sequence
  Description of Artificial Sequence: Synthetic polypeptide
  XENP024208 1C11_H3_L3.124_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 34253 - protein, 117 aa, Artificial Sequence; identical to SEQ ID NO: 33034
  Description of Artificial Sequence: Synthetic polypeptide
  VH of XENP024208

SEQ ID NO: 34254 - protein, 114 aa, Artificial Sequence
  Description of Artificial Sequence: Synthetic polypeptide
  VL of XENP024208
DVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIKGS

SEQ ID NO: 34255 - protein, 5 aa, Artificial Sequence
  Description of Artificial Sequence: Synthetic peptide
  XENP024208 vhCDR1
HYGMN

SEQ ID NO: 34256 - protein, 17 aa, Artificial Sequence
  Description of Artificial Sequence: Synthetic peptide
  XENP024208 vhCDR2
WINTYTGEPTYADGFTG

SEQ ID NO: 34257 - protein, 8 aa, Artificial Sequence
  Description of Artificial Sequence: Synthetic peptide
  XENP024208 vhCDR3
DYYGSSPY

SEQ ID NO: 34258 - protein, 16 aa, Artificial Sequence
  Description of Artificial Sequence: Synthetic peptide
  XENP024208 vlCDR1
KSSQSIVHSNGNTYLE

SEQ ID NO: 34259 - protein, 7 aa, Artificial Sequence
  Description of Artificial Sequence: Synthetic peptide
  XENP024208 vlCDR2
KVSNRFS

SEQ ID NO: 34260 - protein, 9 aa, Artificial Sequence
  Description of Artificial Sequence: Synthetic peptide
  XENP024208 vlCDR3
FQGSHVPNT

SEQ ID NO: 34261 - protein, 251 aa, Artificial Sequence
  Description of Artificial Sequence: Synthetic polypeptide
  XENP024209 1C11_H3_L3.125_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 34262 - protein, 117 aa, Artificial Sequence; identical to SEQ ID NO: 33034
  Description of Artificial Sequence: Synthetic polypeptide
  VH of XENP024209

SEQ ID NO: 34263 - protein, 114 aa, Artificial Sequence
  Description of Artificial Sequence: Synthetic polypeptide
  VL of XENP024209
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKGS

SEQ ID NO: 34264 - protein, 5 aa, Artificial Sequence
  Description of Artificial Sequence: Synthetic peptide
  XENP024209 vhCDR1
HYGMN

SEQ ID NO: 34265 - protein, 17 aa, Artificial Sequence
  Description of Artificial Sequence: Synthetic peptide
  XENP024209 vhCDR2
WINTYTGEPTYADGFTG

SEQ ID NO: 34266 - protein, 8 aa, Artificial Sequence
  Description of Artificial Sequence: Synthetic peptide
  XENP024209 vhCDR3
DYYGSSPY

SEQ ID NO: 34267 - protein, 16 aa, Artificial Sequence
  Description of Artificial Sequence: Synthetic peptide
  XENP024209 vlCDR1
KSSQSIVHSNGNTYLE

SEQ ID NO: 34268 - protein, 7 aa, Artificial Sequence
  Description of Artificial Sequence: Synthetic peptide
  XENP024209 vlCDR2
KVSNRFS

SEQ ID NO: 34269 - protein, 9 aa, Artificial Sequence
  Description of Artificial Sequence: Synthetic peptide
  XENP024209 vlCDR3
FQGSHVPNT

SEQ ID NO: 34270 - protein, 251 aa, Artificial Sequence
  Description of Artificial Sequence: Synthetic polypeptide
  XENP024210 1C11_H3_L3.132_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 34271 - protein, 117 aa, Artificial Sequence; identical to SEQ ID NO: 33034
  Description of Artificial Sequence: Synthetic polypeptide
  VH of XENP024210

SEQ ID NO: 34272 - protein, 114 aa, Artificial Sequence
  Description of Artificial Sequence: Synthetic polypeptide
  VL of XENP024210
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIKGS

SEQ ID NO: 34273 - protein, 5 aa, Artificial Sequence
  Description of Artificial Sequence: Synthetic peptide
  XENP024210 vhCDR1
HYGMN

SEQ ID NO: 34274 - protein, 17 aa, Artificial Sequence
  Description of Artificial Sequence: Synthetic peptide
  XENP024210 vhCDR2
WINTYTGEPTYADGFTG

SEQ ID NO: 34275 - protein, 8 aa, Artificial Sequence
  Description of Artificial Sequence: Synthetic peptide
  XENP024210 vhCDR3
DYYGSSPY

SEQ ID NO: 34276 - protein, 16 aa, Artificial Sequence
  Description of Artificial Sequence: Synthetic peptide
  XENP024210 vlCDR1
KSSQSIVHSNGNTYLE

SEQ ID NO: 34277 - protein, 7 aa, Artificial Sequence
  Description of Artificial Sequence: Synthetic peptide
  XENP024210 vlCDR2
KVSNRFS

SEQ ID NO: 34278 - protein, 9 aa, Artificial Sequence
  Description of Artificial Sequence: Synthetic peptide
  XENP024210 vlCDR3
FQGSHVPNT

SEQ ID NO: 34279 - protein, 251 aa, Artificial Sequence
  Description of Artificial Sequence: Synthetic polypeptide
  XENP024211 1C11_H3.78_L3_scFv
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34280 - protein, 117 aa, Artificial Sequence
  Description of Artificial Sequence: Synthetic polypeptide
  VH of XENP024211
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 34281 - protein, 114 aa, Artificial Sequence; identical to SEQ ID NO: 33651
  Description of Artificial Sequence: Synthetic polypeptide
  VL of XENP024211

SEQ ID NO: 34282 - protein, 5 aa, Artificial Sequence
  Description of Artificial Sequence: Synthetic peptide
  XENP024211 vhCDR1
HYGMN

SEQ ID NO: 34283 - protein, 17 aa, Artificial Sequence
  Description of Artificial Sequence: Synthetic peptide
  XENP024211 vhCDR2
WINTNTGEPTYADGFTG

SEQ ID NO: 34284 - protein, 8 aa, Artificial Sequence
  Description of Artificial Sequence: Synthetic peptide
  XENP024211 vhCDR3
DYYGSSPY

SEQ ID NO: 34285 - protein, 16 aa, Artificial Sequence
  Description of Artificial Sequence: Synthetic peptide
  XENP024211 vlCDR1
KSSQSIVHSNGNTYLE

SEQ ID NO: 34286 - protein, 7 aa, Artificial Sequence
  Description of Artificial Sequence: Synthetic peptide
  XENP024211 vlCDR2
KVSNRFS

SEQ ID NO: 34287 - protein, 9 aa, Artificial Sequence
  Description of Artificial Sequence: Synthetic peptide
  XENP024211 vlCDR3
FQGSHVPNT

SEQ ID NO: 34288 - protein, 251 aa, Artificial Sequence
  Description of Artificial Sequence: Synthetic polypeptide
  XENP024212 1C11_H3.80_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34289 - protein, 117 aa, Artificial Sequence
  Description of Artificial Sequence: Synthetic polypeptide
  VH of XENP024212
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSS

SEQ ID NO: 34290 - protein, 114 aa, Artificial Sequence; identical to SEQ ID NO: 33651
  Description of Artificial Sequence: Synthetic polypeptide
  VL of XENP024212

SEQ ID NO: 34291 - protein, 5 aa, Artificial Sequence
  Description of Artificial Sequence: Synthetic peptide
  XENP024212 vhCDR1
HYGMN

SEQ ID NO: 34292 - protein, 17 aa, Artificial Sequence
  Description of Artificial Sequence: Synthetic peptide
  XENP024212 vhCDR2
WINTNTGEPTYADGFTG

SEQ ID NO: 34293 - protein, 8 aa, Artificial Sequence
  Description of Artificial Sequence: Synthetic peptide
  XENP024212 vhCDR3
DYYGSSPY

SEQ ID NO: 34294 - protein, 16 aa, Artificial Sequence
  Description of Artificial Sequence: Synthetic peptide
  XENP024212 vlCDR1
KSSQSIVHSNGNTYLE

SEQ ID NO: 34295 - protein, 7 aa, Artificial Sequence
  Description of Artificial Sequence: Synthetic peptide
  XENP024212 vlCDR2
KVSNRFS

SEQ ID NO: 34296 - protein, 9 aa, Artificial Sequence
  Description of Artificial Sequence: Synthetic peptide
  XENP024212 vlCDR3
FQGSHVPNT

SEQ ID NO: 34297 - protein, 251 aa, Artificial Sequence
  Description of Artificial Sequence: Synthetic polypeptide
  XENP024213 1C11_H3.81_L3_scFv
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34298 - protein, 117 aa, Artificial Sequence
  Description of Artificial Sequence: Synthetic polypeptide
  VH of XENP024213
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSS

SEQ ID NO: 34299 - protein, 114 aa, Artificial Sequence; identical to SEQ ID NO: 33651
  Description of Artificial Sequence: Synthetic polypeptide
  VL of XENP024213

SEQ ID NO: 34300 - protein, 5 aa, Artificial Sequence
  Description of Artificial Sequence: Synthetic peptide
  XENP024213 vhCDR1
HYGMN

SEQ ID NO: 34301 - protein, 17 aa, Artificial Sequence
  Description of Artificial Sequence: Synthetic peptide
  XENP024213 vhCDR2
WINTYTGEPTYADKFKG

SEQ ID NO: 34302 - protein, 8 aa, Artificial Sequence
  Description of Artificial Sequence: Synthetic peptide
  XENP024213 vhCDR3
DYYGSSPY

SEQ ID NO: 34303 - protein, 16 aa, Artificial Sequence
  Description of Artificial Sequence: Synthetic peptide
  XENP024213 vlCDR1
KSSQSIVHSNGNTYLE

SEQ ID NO: 34304 - protein, 7 aa, Artificial Sequence
  Description of Artificial Sequence: Synthetic peptide
  XENP024213 vlCDR2
KVSNRFS

SEQ ID NO: 34305 - protein, 9 aa, Artificial Sequence
  Description of Artificial Sequence: Synthetic peptide
  XENP024213 vlCDR3
FQGSHVPNT

SEQ ID NO: 34306 - protein, 251 aa, Artificial Sequence
  Description of Artificial Sequence: Synthetic polypeptide
  XENP024214 1C11_H3.82_L3_scFv
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34307 - protein, 117 aa, Artificial Sequence
  Description of Artificial Sequence: Synthetic polypeptide
  VH of XENP024214
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSS

SEQ ID NO: 34308 - protein, 114 aa, Artificial Sequence; identical to SEQ ID NO: 33651
  Description of Artificial Sequence: Synthetic polypeptide
  VL of XENP024214

SEQ ID NO: 34309 - protein, 5 aa, Artificial Sequence
  Description of Artificial Sequence: Synthetic peptide
  XENP024214 vhCDR1
HYGMN

SEQ ID NO: 34310 - protein, 17 aa, Artificial Sequence
  Description of Artificial Sequence: Synthetic peptide
  XENP024214 vhCDR2
WINTYTGEPTYADKFQG

SEQ ID NO: 34311 - protein, 8 aa, Artificial Sequence
  Description of Artificial Sequence: Synthetic peptide
  XENP024214 vhCDR3
DYYGSSPY

SEQ ID NO: 34312 - protein, 16 aa, Artificial Sequence
  Description of Artificial Sequence: Synthetic peptide
  XENP024214 vlCDR1
KSSQSIVHSNGNTYLE

SEQ ID NO: 34313 - protein, 7 aa, Artificial Sequence
  Description of Artificial Sequence: Synthetic peptide
  XENP024214 vlCDR2
KVSNRFS

SEQ ID NO: 34314 - protein, 9 aa, Artificial Sequence
  Description of Artificial Sequence: Synthetic peptide
  XENP024214 vlCDR3
FQGSHVPNT

SEQ ID NO: 34315 - protein, 251 aa, Artificial Sequence
  Description of Artificial Sequence: Synthetic polypeptide
  XENP024215 1C11_H3.83_L3_scFv
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34316 - protein, 117 aa, Artificial Sequence
  Description of Artificial Sequence: Synthetic polypeptide
  VH of XENP024215
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSS

SEQ ID NO: 34317 - protein, 114 aa, Artificial Sequence; identical to SEQ ID NO: 33651
  Description of Artificial Sequence: Synthetic polypeptide
  VL of XENP024215

SEQ ID NO: 34318 - protein, 5 aa, Artificial Sequence
  Description of Artificial Sequence: Synthetic peptide
  XENP024215 vhCDR1
HYGMN

SEQ ID NO: 34319 - protein, 17 aa, Artificial Sequence
  Description of Artificial Sequence: Synthetic peptide
  XENP024215 vhCDR2
WINTNTGEPTYADGFTG

SEQ ID NO: 34320 - protein, 8 aa, Artificial Sequence
  Description of Artificial Sequence: Synthetic peptide
  XENP024215 vhCDR3
DYYGSSPY

SEQ ID NO: 34321 - protein, 16 aa, Artificial Sequence
  Description of Artificial Sequence: Synthetic peptide
  XENP024215 vlCDR1
KSSQSIVHSNGNTYLE

SEQ ID NO: 34322 - protein, 7 aa, Artificial Sequence
  Description of Artificial Sequence: Synthetic peptide
  XENP024215 vlCDR2
KVSNRFS

SEQ ID NO: 34323 - protein, 9 aa, Artificial Sequence
  Description of Artificial Sequence: Synthetic peptide
  XENP024215 vlCDR3
FQGSHVPNT

SEQ ID NO: 34324 - protein, 251 aa, Artificial Sequence
  Description of Artificial Sequence: Synthetic polypeptide
  XENP024216 1C11_H3.84_L3_scFv
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34325 - protein, 117 aa, Artificial Sequence
  Description of Artificial Sequence: Synthetic polypeptide
  VH of XENP024216
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSS

SEQ ID NO: 34326 - protein, 114 aa, Artificial Sequence; identical to SEQ ID NO: 33651
  Description of Artificial Sequence: Synthetic polypeptide
  VL of XENP024216

SEQ ID NO: 34327 - protein, 5 aa, Artificial Sequence
  Description of Artificial Sequence: Synthetic peptide
  XENP024216 vhCDR1
HYGMN

SEQ ID NO: 34328 - protein, 17 aa, Artificial Sequence
  Description of Artificial Sequence: Synthetic peptide
  XENP024216 vhCDR2
WINTYTGEPTYADKFKG

SEQ ID NO: 34329 - protein, 8 aa, Artificial Sequence
  Description of Artificial Sequence: Synthetic peptide
  XENP024216 vhCDR3
DYYGSSPY

SEQ ID NO: 34330 - protein, 16 aa, Artificial Sequence
  Description of Artificial Sequence: Synthetic peptide
  XENP024216 vlCDR1
KSSQSIVHSNGNTYLE

SEQ ID NO: 34331 - protein, 7 aa, Artificial Sequence
  Description of Artificial Sequence: Synthetic peptide
  XENP024216 vlCDR2
KVSNRFS

SEQ ID NO: 34332 - protein, 9 aa, Artificial Sequence
  Description of Artificial Sequence: Synthetic peptide
  XENP024216 vlCDR3
FQGSHVPNT

SEQ ID NO: 34333 - protein, 251 aa, Artificial Sequence
  Description of Artificial Sequence: Synthetic polypeptide
  XENP024217 1C11_H3.85_L3_scFv
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34334 - protein, 117 aa, Artificial Sequence
  Description of Artificial Sequence: Synthetic polypeptide
  VH of XENP024217
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSS

SEQ ID NO: 34335 - protein, 114 aa, Artificial Sequence; identical to SEQ ID NO: 33651
  Description of Artificial Sequence: Synthetic polypeptide
  VL of XENP024217

SEQ ID NO: 34336 - protein, 5 aa, Artificial Sequence
  Description of Artificial Sequence: Synthetic peptide
  XENP024217 vhCDR1
HYGMN

SEQ ID NO: 34337 - protein, 17 aa, Artificial Sequence
  Description of Artificial Sequence: Synthetic peptide
  XENP024217 vhCDR2
WINTYTGEPTYADKFQG

SEQ ID NO: 34338 - protein, 8 aa, Artificial Sequence
  Description of Artificial Sequence: Synthetic peptide
  XENP024217 vhCDR3
DYYGSSPY

SEQ ID NO: 34339 - protein, 16 aa, Artificial Sequence
  Description of Artificial Sequence: Synthetic peptide
  XENP024217 vlCDR1
KSSQSIVHSNGNTYLE

SEQ ID NO: 34340 - protein, 7 aa, Artificial Sequence
  Description of Artificial Sequence: Synthetic peptide
  XENP024217 vlCDR2
KVSNRFS

SEQ ID NO: 34341 - protein, 9 aa, Artificial Sequence
  Description of Artificial Sequence: Synthetic peptide
  XENP024217 vlCDR3
FQGSHVPNT

SEQ ID NO: 34342 - protein, 251 aa, Artificial Sequence
  Description of Artificial Sequence: Synthetic polypeptide
  XENP024218 1C11_H3.86_L3_scFv
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34343 - protein, 117 aa, Artificial Sequence
  Description of Artificial Sequence: Synthetic polypeptide
  VH of XENP024218
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34344 - protein, 114 aa, Artificial Sequence; identical to SEQ ID NO: 33651
  Description of Artificial Sequence: Synthetic polypeptide
  VL of XENP024218

SEQ ID NO: 34345 - protein, 5 aa, Artificial Sequence
  Description of Artificial Sequence: Synthetic peptide
  XENP024218 vhCDR1
HYGMN

SEQ ID NO: 34346 - protein, 17 aa, Artificial Sequence
  Description of Artificial Sequence: Synthetic peptide
  XENP024218 vhCDR2
WINTYTGEPTYADGFTG

SEQ ID NO: 34347 - protein, 8 aa, Artificial Sequence
  Description of Artificial Sequence: Synthetic peptide
  XENP024218 vhCDR3
DYYGSSPY

SEQ ID NO: 34348 - protein, 16 aa, Artificial Sequence
  Description of Artificial Sequence: Synthetic peptide
  XENP024218 vlCDR1
KSSQSIVHSNGNTYLE

SEQ ID NO: 34349 - protein, 7 aa, Artificial Sequence
  Description of Artificial Sequence: Synthetic peptide
  XENP024218 vlCDR2
KVSNRFS

SEQ ID NO: 34350 - protein, 9 aa, Artificial Sequence
  Description of Artificial Sequence: Synthetic peptide
  XENP024218 vlCDR3
FQGSHVPNT

SEQ ID NO: 34351 - protein, 251 aa, Artificial Sequence
  Description of Artificial Sequence: Synthetic polypeptide
  XENP024219 1C11_H3.88_L3_scFv
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34352 - protein, 117 aa, Artificial Sequence
  Description of Artificial Sequence: Synthetic polypeptide
  VH of XENP024219
QIQLVESGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34353 - protein, 114 aa, Artificial Sequence; identical to SEQ ID NO: 33651
  Description of Artificial Sequence: Synthetic polypeptide
  VL of XENP024219

SEQ ID NO: 34354 - protein, 5 aa, Artificial Sequence
  Description of Artificial Sequence: Synthetic peptide
  XENP024219 vhCDR1
HYGMN

SEQ ID NO: 34355 - protein, 17 aa, Artificial Sequence
  Description of Artificial Sequence: Synthetic peptide
  XENP024219 vhCDR2
WINTYTGEPTYADGFTG

SEQ ID NO: 34356 - protein, 8 aa, Artificial Sequence
  Description of Artificial Sequence: Synthetic peptide
  XENP024219 vhCDR3
DYYGSSPY

SEQ ID NO: 34357 - protein, 16 aa, Artificial Sequence
  Description of Artificial Sequence: Synthetic peptide
  XENP024219 vlCDR1
KSSQSIVHSNGNTYLE

SEQ ID NO: 34358 - protein, 7 aa, Artificial Sequence
  Description of Artificial Sequence: Synthetic peptide
  XENP024219 vlCDR2
KVSNRFS

SEQ ID NO: 34359 - protein, 9 aa, Artificial Sequence
  Description of Artificial Sequence: Synthetic peptide
  XENP024219 vlCDR3
FQGSHVPNT

SEQ ID NO: 34360 - protein, 251 aa, Artificial Sequence
  Description of Artificial Sequence: Synthetic polypeptide
  XENP024220 1C11_H3.89_L3_scFv
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34361 - protein, 117 aa, Artificial Sequence
  Description of Artificial Sequence: Synthetic polypeptide
  VH of XENP024220
QIQLVQSGSGLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34362 - protein, 114 aa, Artificial Sequence; identical to SEQ ID NO: 33651
  Description of Artificial Sequence: Synthetic polypeptide
  VL of XENP024220

SEQ ID NO: 34363 - protein, 5 aa, Artificial Sequence
  Description of Artificial Sequence: Synthetic peptide
  XENP024220 vhCDR1
HYGMN

SEQ ID NO: 34364 - protein, 17 aa, Artificial Sequence
  Description of Artificial Sequence: Synthetic peptide
  XENP024220 vhCDR2
WINTYTGEPTYADGFTG

SEQ ID NO: 34365 - protein, 8 aa, Artificial Sequence
  Description of Artificial Sequence: Synthetic peptide
  XENP024220 vhCDR3
DYYGSSPY

SEQ ID NO: 34366 - protein, 16 aa, Artificial Sequence
  Description of Artificial Sequence: Synthetic peptide
  XENP024220 vlCDR1
KSSQSIVHSNGNTYLE

SEQ ID NO: 34367 - protein, 7 aa, Artificial Sequence
  Description of Artificial Sequence: Synthetic peptide
  XENP024220 vlCDR2
KVSNRFS

SEQ ID NO: 34368 - protein, 9 aa, Artificial Sequence
  Description of Artificial Sequence: Synthetic peptide
  XENP024220 vlCDR3
FQGSHVPNT

SEQ ID NO: 34369 - protein, 251 aa, Artificial Sequence
  Description of Artificial Sequence: Synthetic polypeptide
  XENP024221 1C11_H3.90_L3_scFv
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34370 - protein, 117 aa, Artificial Sequence
  Description of Artificial Sequence: Synthetic polypeptide
  VH of XENP024221
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34371 - protein, 114 aa, Artificial Sequence; identical to SEQ ID NO: 33651
  Description of Artificial Sequence: Synthetic polypeptide
  VL of XENP024221

SEQ ID NO: 34372 - protein, 5 aa, Artificial Sequence
  Description of Artificial Sequence: Synthetic peptide
  XENP024221 vhCDR1
HYGMN

SEQ ID NO: 34373 - protein, 17 aa, Artificial Sequence
  Description of Artificial Sequence: Synthetic peptide
  XENP024221 vhCDR2
WINTYTGEPTYADGFTG

SEQ ID NO: 34374 - protein, 8 aa, Artificial Sequence
  Description of Artificial Sequence: Synthetic peptide
  XENP024221 vhCDR3
DYYGSSPY

SEQ ID NO: 34375 - protein, 16 aa, Artificial Sequence
  Description of Artificial Sequence: Synthetic peptide
  XENP024221 vlCDR1
KSSQSIVHSNGNTYLE

SEQ ID NO: 34376 - protein, 7 aa, Artificial Sequence
  Description of Artificial Sequence: Synthetic peptide
  XENP024221 vlCDR2
KVSNRFS

SEQ ID NO: 34377 - protein, 9 aa, Artificial Sequence
  Description of Artificial Sequence: Synthetic peptide
  XENP024221 vlCDR3
FQGSHVPNT

SEQ ID NO: 34378 - protein, 251 aa, Artificial Sequence
  Description of Artificial Sequence: Synthetic polypeptide
  XENP024222 1C11_H3.91_L3_scFv
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34379 - protein, 117 aa, Artificial Sequence
  Description of Artificial Sequence: Synthetic polypeptide
  VH of XENP024222
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34380 - protein, 114 aa, Artificial Sequence; identical to SEQ ID NO: 33651
  Description of Artificial Sequence: Synthetic polypeptide
  VL of XENP024222

SEQ ID NO: 34381 - protein, 5 aa, Artificial Sequence
  Description of Artificial Sequence: Synthetic peptide
  XENP024222 vhCDR1
HYGMN

SEQ ID NO: 34382 - protein, 17 aa, Artificial Sequence
  Description of Artificial Sequence: Synthetic peptide
  XENP024222 vhCDR2
WINTYTGEPTYADGFTG

SEQ ID NO: 34383 - protein, 8 aa, Artificial Sequence
  Description of Artificial Sequence: Synthetic peptide
  XENP024222 vhCDR3
DYYGSSPY

SEQ ID NO: 34384 - protein, 16 aa, Artificial Sequence
  Description of Artificial Sequence: Synthetic peptide
  XENP024222 vlCDR1
KSSQSIVHSNGNTYLE

SEQ ID NO: 34385 - protein, 7 aa, Artificial Sequence
  Description of Artificial Sequence: Synthetic peptide
  XENP024222 vlCDR2
KVSNRFS

SEQ ID NO: 34386 - protein, 9 aa, Artificial Sequence
  Description of Artificial Sequence: Synthetic peptide
  XENP024222 vlCDR3
FQGSHVPNT

SEQ ID NO: 34387 - protein, 251 aa, Artificial Sequence
  Description of Artificial Sequence: Synthetic polypeptide
  XENP024223 1C11_H3.92_L3_scFv
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34388 - protein, 117 aa, Artificial Sequence
  Description of Artificial Sequence: Synthetic polypeptide
  VH of XENP024223
QIQLVQSGSELKQPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34389 - protein, 114 aa, Artificial Sequence; identical to SEQ ID NO: 33651
  Description of Artificial Sequence: Synthetic polypeptide
  VL of XENP024223

SEQ ID NO: 34390 - protein, 5 aa, Artificial Sequence
  Description of Artificial Sequence: Synthetic peptide
  XENP024223 vhCDR1
HYGMN

SEQ ID NO: 34391 - protein, 17 aa, Artificial Sequence
  Description of Artificial Sequence: Synthetic peptide
  XENP024223 vhCDR2
WINTYTGEPTYADGFTG

SEQ ID NO: 34392 - protein, 8 aa, Artificial Sequence
  Description of Artificial Sequence: Synthetic peptide
  XENP024223 vhCDR3
DYYGSSPY

SEQ ID NO: 34393 - protein, 16 aa, Artificial Sequence
  Description of Artificial Sequence: Synthetic peptide
  XENP024223 vlCDR1
KSSQSIVHSNGNTYLE

SEQ ID NO: 34394 - protein, 7 aa, Artificial Sequence
  Description of Artificial Sequence: Synthetic peptide
  XENP024223 vlCDR2
KVSNRFS

SEQ ID NO: 34395 - protein, 9 aa, Artificial Sequence
  Description of Artificial Sequence: Synthetic peptide
  XENP024223 vlCDR3
FQGSHVPNT

SEQ ID NO: 34396 - protein, 251 aa, Artificial Sequence
  Description of Artificial Sequence: Synthetic polypeptide
  XENP024224 1C11_H3.93_L3_scFv
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34397 - protein, 117 aa, Artificial Sequence
  Description of Artificial Sequence: Synthetic polypeptide
  VH of XENP024224
QIQLVQSGSELKKPSASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34398 - protein, 114 aa, Artificial Sequence; identical to SEQ ID NO: 33651
  Description of Artificial Sequence: Synthetic polypeptide
  VL of XENP024224

SEQ ID NO: 34399 - protein, 5 aa, Artificial Sequence
  Description of Artificial Sequence: Synthetic peptide
  XENP024224 vhCDR1
HYGMN

SEQ ID NO: 34400 - protein, 17 aa, Artificial Sequence
  Description of Artificial Sequence: Synthetic peptide
  XENP024224 vhCDR2
WINTYTGEPTYADGFTG

SEQ ID NO: 34401 - protein, 8 aa, Artificial Sequence
  Description of Artificial Sequence: Synthetic peptide
  XENP024224 vhCDR3
DYYGSSPY

SEQ ID NO: 34402 - protein, 16 aa, Artificial Sequence
  Description of Artificial Sequence: Synthetic peptide
  XENP024224 vlCDR1
KSSQSIVHSNGNTYLE

SEQ ID NO: 34403 - protein, 7 aa, Artificial Sequence
  Description of Artificial Sequence: Synthetic peptide
  XENP024224 vlCDR2
KVSNRFS

SEQ ID NO: 34404 - protein, 9 aa, Artificial Sequence
  Description of Artificial Sequence: Synthetic peptide
  XENP024224 vlCDR3
FQGSHVPNT

SEQ ID NO: 34405 - protein, 251 aa, Artificial Sequence
  Description of Artificial Sequence: Synthetic polypeptide
  XENP024225 1C11_H3.94_L3_scFv
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34406 - protein, 117 aa, Artificial Sequence
  Description of Artificial Sequence: Synthetic polypeptide
  VH of XENP024225
QIQLVQSGSELKKPTASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34407 - protein, 114 aa, Artificial Sequence; identical to SEQ ID NO: 33651
  Description of Artificial Sequence: Synthetic polypeptide
  VL of XENP024225

SEQ ID NO: 34408 - protein, 5 aa, Artificial Sequence
  Description of Artificial Sequence: Synthetic peptide
  XENP024225 vhCDR1
HYGMN

SEQ ID NO: 34409 - protein, 17 aa, Artificial Sequence
  Description of Artificial Sequence: Synthetic peptide
  XENP024225 vhCDR2
WINTYTGEPTYADGFTG

SEQ ID NO: 34410 - protein, 8 aa, Artificial Sequence
  Description of Artificial Sequence: Synthetic peptide
  XENP024225 vhCDR3
DYYGSSPY

SEQ ID NO: 34411 - protein, 16 aa, Artificial Sequence
  Description of Artificial Sequence: Synthetic peptide
  XENP024225 vlCDR1
KSSQSIVHSNGNTYLE

SEQ ID NO: 34412 - protein, 7 aa, Artificial Sequence
  Description of Artificial Sequence: Synthetic peptide
  XENP024225 vlCDR2
KVSNRFS

SEQ ID NO: 34413 - protein, 9 aa, Artificial Sequence
  Description of Artificial Sequence: Synthetic peptide
  XENP024225 vlCDR3
FQGSHVPNT

SEQ ID NO: 34414 - protein, 251 aa, Artificial Sequence
  Description of Artificial Sequence: Synthetic polypeptide
  XENP024226 1C11_H3.95_L3_scFv
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34415 - protein, 117 aa, Artificial Sequence
  Description of Artificial Sequence: Synthetic polypeptide
  VH of XENP024226
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34416 - protein, 114 aa, Artificial Sequence; identical to SEQ ID NO: 33651
  Description of Artificial Sequence: Synthetic polypeptide
  VL of XENP024226

SEQ ID NO: 34417 - protein, 5 aa, Artificial Sequence
  Description of Artificial Sequence: Synthetic peptide
  XENP024226 vhCDR1
HYGMN

SEQ ID NO: 34418 - protein, 17 aa, Artificial Sequence
  Description of Artificial Sequence: Synthetic peptide
  XENP024226 vhCDR2
WINTYTGEPTYADGFTG

SEQ ID NO: 34419 - protein, 8 aa, Artificial Sequence
  Description of Artificial Sequence: Synthetic peptide
  XENP024226 vhCDR3
DYYGSSPY

SEQ ID NO: 34420 - protein, 16 aa, Artificial Sequence
  Description of Artificial Sequence: Synthetic peptide
  XENP024226 vlCDR1
KSSQSIVHSNGNTYLE

SEQ ID NO: 34421 - protein, 7 aa, Artificial Sequence
  Description of Artificial Sequence: Synthetic peptide
  XENP024226 vlCDR2
KVSNRFS

SEQ ID NO: 34422 - protein, 9 aa, Artificial Sequence
  Description of Artificial Sequence: Synthetic peptide
  XENP024226 vlCDR3
FQGSHVPNT

SEQ ID NO: 34423 - protein, 251 aa, Artificial Sequence
  Description of Artificial Sequence: Synthetic polypeptide
  XENP024227 1C11_H3.96_L3_scFv
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34424 - protein, 117 aa, Artificial Sequence
  Description of Artificial Sequence: Synthetic polypeptide
  VH of XENP024227
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34425 - protein, 114 aa, Artificial Sequence; identical to SEQ ID NO: 33651
  Description of Artificial Sequence: Synthetic polypeptide
  VL of XENP024227

SEQ ID NO: 34426 - protein, 5 aa, Artificial Sequence
  Description of Artificial Sequence: Synthetic peptide
  XENP024227 vhCDR1
HYGMN

SEQ ID NO: 34427 - protein, 17 aa, Artificial Sequence
  Description of Artificial Sequence: Synthetic peptide
  XENP024227 vhCDR2
WINTYTGEPTYADGFTG

SEQ ID NO: 34428 - protein, 8 aa, Artificial Sequence
  Description of Artificial Sequence: Synthetic peptide
  XENP024227 vhCDR3
DYYGSSPY

SEQ ID NO: 34429 - protein, 16 aa, Artificial Sequence
  Description of Artificial Sequence: Synthetic peptide
  XENP024227 vlCDR1
KSSQSIVHSNGNTYLE

SEQ ID NO: 34430 - protein, 7 aa, Artificial Sequence
  Description of Artificial Sequence: Synthetic peptide
  XENP024227 vlCDR2
KVSNRFS

SEQ ID NO: 34431 - protein, 9 aa, Artificial Sequence
  Description of Artificial Sequence: Synthetic peptide
  XENP024227 vlCDR3
FQGSHVPNT

SEQ ID NO: 34432 - protein, 251 aa, Artificial Sequence
  Description of Artificial Sequence: Synthetic polypeptide
  XENP024228 1C11_H3.97_L3_scFv
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34433 - protein, 117 aa, Artificial Sequence
  Description of Artificial Sequence: Synthetic polypeptide
  VH of XENP024228
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34434 - protein, 114 aa, Artificial Sequence; identical to SEQ ID NO: 33651
  Description of Artificial Sequence: Synthetic polypeptide
  VL of XENP024228

SEQ ID NO: 34435 - protein, 5 aa, Artificial Sequence
  Description of Artificial Sequence: Synthetic peptide
  XENP024228 vhCDR1
HYGMN

SEQ ID NO: 34436 - protein, 17 aa, Artificial Sequence
  Description of Artificial Sequence: Synthetic peptide
  XENP024228 vhCDR2
WINTYTGEPTYADGFTG

SEQ ID NO: 34437 - protein, 8 aa, Artificial Sequence
  Description of Artificial Sequence: Synthetic peptide
  XENP024228 vhCDR3
DYYGSSPY

SEQ ID NO: 34438 - protein, 16 aa, Artificial Sequence
  Description of Artificial Sequence: Synthetic peptide
  XENP024228 vlCDR1
KSSQSIVHSNGNTYLE

SEQ ID NO: 34439 - protein, 7 aa, Artificial Sequence
  Description of Artificial Sequence: Synthetic peptide
  XENP024228 vlCDR2
KVSNRFS

SEQ ID NO: 34440 - protein, 9 aa, Artificial Sequence
  Description of Artificial Sequence: Synthetic peptide
  XENP024228 vlCDR3
FQGSHVPNT

SEQ ID NO: 34441 - protein, 251 aa, Artificial Sequence
  Description of Artificial Sequence: Synthetic polypeptide
  XENP024229 1C11_H3.98_L3_scFv
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34442 - protein, 117 aa, Artificial Sequence
  Description of Artificial Sequence: Synthetic polypeptide
  VH of XENP024229
QIQLVQSGSELKKPGRSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34443 - protein, 114 aa, Artificial Sequence; identical to SEQ ID NO: 33651
  Description of Artificial Sequence: Synthetic polypeptide
  VL of XENP024229

SEQ ID NO: 34444 - protein, 5 aa, Artificial Sequence
  Description of Artificial Sequence: Synthetic peptide
  XENP024229 vhCDR1
HYGMN

SEQ ID NO: 34445 - protein, 17 aa, Artificial Sequence
  Description of Artificial Sequence: Synthetic peptide
  XENP024229 vhCDR2
WINTYTGEPTYADGFTG

SEQ ID NO: 34446 - protein, 8 aa, Artificial Sequence
  Description of Artificial Sequence: Synthetic peptide
  XENP024229 vhCDR3
DYYGSSPY

SEQ ID NO: 34447 - protein, 16 aa, Artificial Sequence
  Description of Artificial Sequence: Synthetic peptide
  XENP024229 vlCDR1
KSSQSIVHSNGNTYLE

SEQ ID NO: 34448 - protein, 7 aa, Artificial Sequence
  Description of Artificial Sequence: Synthetic peptide
  XENP024229 vlCDR2
KVSNRFS

SEQ ID NO: 34449 - protein, 9 aa, Artificial Sequence
  Description of Artificial Sequence: Synthetic peptide
  XENP024229 vlCDR3
FQGSHVPNT

SEQ ID NO: 34450 - protein, 251 aa, Artificial Sequence
  Description of Artificial Sequence: Synthetic polypeptide
  XENP024230 1C11_H3.99_L3_scFv
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34451 - protein, 117 aa, Artificial Sequence
  Description of Artificial Sequence: Synthetic polypeptide
  VH of XENP024230
QIQLVQSGSELKKPGATVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34452 - protein, 114 aa, Artificial Sequence; identical to SEQ ID NO: 33651
  Description of Artificial Sequence: Synthetic polypeptide
  VL of XENP024230

SEQ ID NO: 34453 - protein, 5 aa, Artificial Sequence
  Description of Artificial Sequence: Synthetic peptide
  XENP024230 vhCDR1
HYGMN

SEQ ID NO: 34454 - protein, 17 aa, Artificial Sequence
  Description of Artificial Sequence: Synthetic peptide
  XENP024230 vhCDR2
WINTYTGEPTYADGFTG

SEQ ID NO: 34455 - protein, 8 aa, Artificial Sequence
  Description of Artificial Sequence: Synthetic peptide
  XENP024230 vhCDR3
DYYGSSPY

SEQ ID NO: 34456 - protein, 16 aa, Artificial Sequence
  Description of Artificial Sequence: Synthetic peptide
  XENP024230 vlCDR1
KSSQSIVHSNGNTYLE

SEQ ID NO: 34457 - protein, 7 aa, Artificial Sequence
  Description of Artificial Sequence: Synthetic peptide
  XENP024230 vlCDR2
KVSNRFS

SEQ ID NO: 34458 - protein, 9 aa, Artificial Sequence
  Description of Artificial Sequence: Synthetic peptide
  XENP024230 vlCDR3
FQGSHVPNT

SEQ ID NO: 34459 - protein, 251 aa, Artificial Sequence
  Description of Artificial Sequence: Synthetic polypeptide
  XENP024231 1C11_H3.100_L3_scFv
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34460 - protein, 117 aa, Artificial Sequence
  Description of Artificial Sequence: Synthetic polypeptide
  VH of XENP024231
QIQLVQSGSELKKPGASLKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34461 - protein, 114 aa, Artificial Sequence; identical to SEQ ID NO: 33651
  Description of Artificial Sequence: Synthetic polypeptide
  VL of XENP024231

SEQ ID NO: 34462 - protein, 5 aa, Artificial Sequence
  Description of Artificial Sequence: Synthetic peptide
  XENP024231 vhCDR1
HYGMN

SEQ ID NO: 34463 - protein, 17 aa, Artificial Sequence
  Description of Artificial Sequence: Synthetic peptide
  XENP024231 vhCDR2
WINTYTGEPTYADGFTG

SEQ ID NO: 34464 - protein, 8 aa, Artificial Sequence
  Description of Artificial Sequence: Synthetic peptide
  XENP024231 vhCDR3
DYYGSSPY

SEQ ID NO: 34465 - protein, 16 aa, Artificial Sequence
  Description of Artificial Sequence: Synthetic peptide
  XENP024231 vlCDR1
KSSQSIVHSNGNTYLE

SEQ ID NO: 34466 - protein, 7 aa, Artificial Sequence
  Description of Artificial Sequence: Synthetic peptide
  XENP024231 vlCDR2
KVSNRFS

SEQ ID NO: 34467 - protein, 9 aa, Artificial Sequence
  Description of Artificial Sequence: Synthetic peptide
  XENP024231 vlCDR3
FQGSHVPNT

SEQ ID NO: 34468 - protein, 251 aa, Artificial Sequence
  Description of Artificial Sequence: Synthetic polypeptide
  XENP024232 1C11_H3.101_L3_scFv
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34469 - protein, 117 aa, Artificial Sequence
  Description of Artificial Sequence: Synthetic polypeptide
  VH of XENP024232
QIQLVQSGSELKKPGASVRVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34470 - protein, 114 aa, Artificial Sequence; identical to SEQ ID NO: 33651
  Description of Artificial Sequence: Synthetic polypeptide
  VL of XENP024232

SEQ ID NO: 34471 - protein, 5 aa, Artificial Sequence
  Description of Artificial Sequence: Synthetic peptide
  XENP024232 vhCDR1
HYGMN

SEQ ID NO: 34472 - protein, 17 aa, Artificial Sequence
  Description of Artificial Sequence: Synthetic peptide
  XENP024232 vhCDR2
WINTYTGEPTYADGFTG

SEQ ID NO: 34473 - protein, 8 aa, Artificial Sequence
  Description of Artificial Sequence: Synthetic peptide
  XENP024232 vhCDR3
DYYGSSPY

SEQ ID NO: 34474 - protein, 16 aa, Artificial Sequence
  Description of Artificial Sequence: Synthetic peptide
  XENP024232 vlCDR1
KSSQSIVHSNGNTYLE

SEQ ID NO: 34475 - protein, 7 aa, Artificial Sequence
  Description of Artificial Sequence: Synthetic peptide
  XENP024232 vlCDR2
KVSNRFS

SEQ ID NO: 34476 - protein, 9 aa, Artificial Sequence
  Description of Artificial Sequence: Synthetic peptide
  XENP024232 vlCDR3
FQGSHVPNT

SEQ ID NO: 34477 - protein, 251 aa, Artificial Sequence
  Description of Artificial Sequence: Synthetic polypeptide
  XENP024233 1C11_H3.102_L3_scFv
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34478 - protein, 117 aa, Artificial Sequence
  Description of Artificial Sequence: Synthetic polypeptide
  VH of XENP024233
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34479 - protein, 114 aa, Artificial Sequence; identical to SEQ ID NO: 33651
  Description of Artificial Sequence: Synthetic polypeptide
  VL of XENP024233

SEQ ID NO: 34480 - protein, 5 aa, Artificial Sequence
  Description of Artificial Sequence: Synthetic peptide
  XENP024233 vhCDR1
HYGMN

SEQ ID NO: 34481 - protein, 17 aa, Artificial Sequence
  Description of Artificial Sequence: Synthetic peptide
  XENP024233 vhCDR2
WINTYTGEPTYADGFTG

SEQ ID NO: 34482 - protein, 8 aa, Artificial Sequence
  Description of Artificial Sequence: Synthetic peptide
  XENP024233 vhCDR3
DYYGSSPY

SEQ ID NO: 34483 - protein, 16 aa, Artificial Sequence
  Description of Artificial Sequence: Synthetic peptide
  XENP024233 vlCDR1
KSSQSIVHSNGNTYLE

SEQ ID NO: 34484 - protein, 7 aa, Artificial Sequence
  Description of Artificial Sequence: Synthetic peptide
  XENP024233 vlCDR2
KVSNRFS

SEQ ID NO: 34485 - protein, 9 aa, Artificial Sequence
  Description of Artificial Sequence: Synthetic peptide
  XENP024233 vlCDR3
FQGSHVPNT

SEQ ID NO: 34486 - protein, 251 aa, Artificial Sequence
  Description of Artificial Sequence: Synthetic polypeptide
  XENP024234 1C11_H3.103_L3_scFv
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34487 - protein, 117 aa, Artificial Sequence
  Description of Artificial Sequence: Synthetic polypeptide
  VH of XENP024234
QIQLVQSGSELKKPGASVKVTCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34488 - protein, 114 aa, Artificial Sequence; identical to SEQ ID NO: 33651
  Description of Artificial Sequence: Synthetic polypeptide
  VL of XENP024234

SEQ ID NO: 34489 - protein, 5 aa, Artificial Sequence
  Description of Artificial Sequence: Synthetic peptide
  XENP024234 vhCDR1
HYGMN

SEQ ID NO: 34490 - protein, 17 aa, Artificial Sequence
  Description of Artificial Sequence: Synthetic peptide
  XENP024234 vhCDR2
WINTYTGEPTYADGFTG

SEQ ID NO: 34491 - protein, 8 aa, Artificial Sequence
  Description of Artificial Sequence: Synthetic peptide
  XENP024234 vhCDR3
DYYGSSPY

SEQ ID NO: 34492 - protein, 16 aa, Artificial Sequence
  Description of Artificial Sequence: Synthetic peptide
  XENP024234 vlCDR1
KSSQSIVHSNGNTYLE

SEQ ID NO: 34493 - protein, 7 aa, Artificial Sequence
  Description of Artificial Sequence: Synthetic peptide
  XENP024234 vlCDR2
KVSNRFS

SEQ ID NO: 34494 - protein, 9 aa, Artificial Sequence
  Description of Artificial Sequence: Synthetic peptide
  XENP024234 vlCDR3
FQGSHVPNT

SEQ ID NO: 34495 - protein, 251 aa, Artificial Sequence
  Description of Artificial Sequence: Synthetic polypeptide
  XENP024235 1C11_H3.104_L3_scFv
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34496 - protein, 117 aa, Artificial Sequence
  Description of Artificial Sequence: Synthetic polypeptide
  VH of XENP024235
QIQLVQSGSELKKPGASVKVSCAASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34497 - protein, 114 aa, Artificial Sequence; identical to SEQ ID NO: 33651
  Description of Artificial Sequence: Synthetic polypeptide
  VL of XENP024235

SEQ ID NO: 34498 - protein, 5 aa, Artificial Sequence
  Description of Artificial Sequence: Synthetic peptide
  XENP024235 vhCDR1
HYGMN

SEQ ID NO: 34499 - protein, 17 aa, Artificial Sequence
  Description of Artificial Sequence: Synthetic peptide
  XENP024235 vhCDR2
WINTYTGEPTYADGFTG

SEQ ID NO: 34500 - protein, 8 aa, Artificial Sequence
  Description of Artificial Sequence: Synthetic peptide
  XENP024235 vhCDR3
DYYGSSPY

SEQ ID NO: 34501 - protein, 16 aa, Artificial Sequence
  Description of Artificial Sequence: Synthetic peptide
  XENP024235 vlCDR1
KSSQSIVHSNGNTYLE

SEQ ID NO: 34502 - protein, 7 aa, Artificial Sequence
  Description of Artificial Sequence: Synthetic peptide
  XENP024235 vlCDR2
KVSNRFS

SEQ ID NO: 34503 - protein, 9 aa, Artificial Sequence
  Description of Artificial Sequence: Synthetic peptide
  XENP024235 vlCDR3
FQGSHVPNT

SEQ ID NO: 34504 - protein, 251 aa, Artificial Sequence
  Description of Artificial Sequence: Synthetic polypeptide
  XENP024236 1C11_H3.105_L3_scFv
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34505 - protein, 117 aa, Artificial Sequence
  Description of Artificial Sequence: Synthetic polypeptide
  VH of XENP024236
QIQLVQSGSELKKPGASVKVSCTASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34506 - protein, 114 aa, Artificial Sequence; identical to SEQ ID NO: 33651
  Description of Artificial Sequence: Synthetic polypeptide
  VL of XENP024236

SEQ ID NO: 34507 - protein, 5 aa, Artificial Sequence
  Description of Artificial Sequence: Synthetic peptide
  XENP024236 vhCDR1
HYGMN

SEQ ID NO: 34508 - protein, 17 aa, Artificial Sequence
  Description of Artificial Sequence: Synthetic peptide
  XENP024236 vhCDR2
WINTYTGEPTYADGFTG

SEQ ID NO: 34509 - protein, 8 aa, Artificial Sequence
  Description of Artificial Sequence: Synthetic peptide
  XENP024236 vhCDR3
DYYGSSPY

SEQ ID NO: 34510 - protein, 16 aa, Artificial Sequence
  Description of Artificial Sequence: Synthetic peptide
  XENP024236 vlCDR1
KSSQSIVHSNGNTYLE

SEQ ID NO: 34511 - protein, 7 aa, Artificial Sequence
  Description of Artificial Sequence: Synthetic peptide
  XENP024236 vlCDR2
KVSNRFS

SEQ ID NO: 34512 - protein, 9 aa, Artificial Sequence
  Description of Artificial Sequence: Synthetic peptide
  XENP024236 vlCDR3
FQGSHVPNT

SEQ ID NO: 34513 - protein, 251 aa, Artificial Sequence
  Description of Artificial Sequence: Synthetic polypeptide
  XENP024237 1C11_H3.106_L3_scFv
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34514 - protein, 117 aa, Artificial Sequence
  Description of Artificial Sequence: Synthetic polypeptide
  VH of XENP024237
QIQLVQSGSELKKPGASVKVSCKVSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34515 - protein, 114 aa, Artificial Sequence; identical to SEQ ID NO: 33651
  Description of Artificial Sequence: Synthetic polypeptide
  VL of XENP024237

SEQ ID NO: 34516 - protein, 5 aa, Artificial Sequence
  Description of Artificial Sequence: Synthetic peptide
  XENP024237 vhCDR1
HYGMN

SEQ ID NO: 34517 - protein, 17 aa, Artificial Sequence
  Description of Artificial Sequence: Synthetic peptide
  XENP024237 vhCDR2
WINTYTGEPTYADGFTG

SEQ ID NO: 34518 - protein, 8 aa, Artificial Sequence
  Description of Artificial Sequence: Synthetic peptide
  XENP024237 vhCDR3
DYYGSSPY

SEQ ID NO: 34519 - protein, 16 aa, Artificial Sequence
  Description of Artificial Sequence: Synthetic peptide
  XENP024237 vlCDR1
KSSQSIVHSNGNTYLE

SEQ ID NO: 34520 - protein, 7 aa, Artificial Sequence
  Description of Artificial Sequence: Synthetic peptide
  XENP024237 vlCDR2
KVSNRFS

SEQ ID NO: 34521 - protein, 9 aa, Artificial Sequence
  Description of Artificial Sequence: Synthetic peptide
  XENP024237 vlCDR3
FQGSHVPNT

SEQ ID NO: 34522 - protein, 251 aa, Artificial Sequence
  Description of Artificial Sequence: Synthetic polypeptide
  XENP024238 1C11_H3.107_L3_scFv
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34523 - protein, 117 aa, Artificial Sequence
  Description of Artificial Sequence: Synthetic polypeptide
  VH of XENP024238
QIQLVQSGSELKKPGASVKVSCKGSGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34524 - protein, 114 aa, Artificial Sequence; identical to SEQ ID NO: 33651
  Description of Artificial Sequence: Synthetic polypeptide
  VL of XENP024238

SEQ ID NO: 34525 - protein, 5 aa, Artificial Sequence
  Description of Artificial Sequence: Synthetic peptide
  XENP024238 vhCDR1
HYGMN

SEQ ID NO: 34526 - protein, 17 aa, Artificial Sequence
  Description of Artificial Sequence: Synthetic peptide
  XENP024238 vhCDR2
WINTYTGEPTYADGFTG

SEQ ID NO: 34527 - protein, 8 aa, Artificial Sequence
  Description of Artificial Sequence: Synthetic peptide
  XENP024238 vhCDR3
DYYGSSPY

SEQ ID NO: 34528 - protein, 16 aa, Artificial Sequence
  Description of Artificial Sequence: Synthetic peptide
  XENP024238 vlCDR1
KSSQSIVHSNGNTYLE

SEQ ID NO: 34529 - protein, 7 aa, Artificial Sequence
  Description of Artificial Sequence: Synthetic peptide
  XENP024238 vlCDR2
KVSNRFS

SEQ ID NO: 34530 - protein, 9 aa, Artificial Sequence
  Description of Artificial Sequence: Synthetic peptide
  XENP024238 vlCDR3
FQGSHVPNT

SEQ ID NO: 34531 - protein, 251 aa, Artificial Sequence
  Description of Artificial Sequence: Synthetic polypeptide
  XENP024239 1C11_H3.109_L3_scFv
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34532 - protein, 117 aa, Artificial Sequence
  Description of Artificial Sequence: Synthetic polypeptide
  VH of XENP024239
QIQLVQSGSELKKPGASVKVSCKASGFTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34533 - protein, 114 aa, Artificial Sequence; identical to SEQ ID NO: 33651
  Description of Artificial Sequence: Synthetic polypeptide
  VL of XENP024239

SEQ ID NO: 34534 - protein, 5 aa, Artificial Sequence
  Description of Artificial Sequence: Synthetic peptide
  XENP024239 vhCDR1
HYGMN

SEQ ID NO: 34535 - protein, 17 aa, Artificial Sequence
  Description of Artificial Sequence: Synthetic peptide
  XENP024239 vhCDR2
WINTYTGEPTYADGFTG

SEQ ID NO: 34536 - protein, 8 aa, Artificial Sequence
  Description of Artificial Sequence: Synthetic peptide
  XENP024239 vhCDR3
DYYGSSPY

SEQ ID NO: 34537 - protein, 16 aa, Artificial Sequence
  Description of Artificial Sequence: Synthetic peptide
  XENP024239 vlCDR1
KSSQSIVHSNGNTYLE

SEQ ID NO: 34538 - protein, 7 aa, Artificial Sequence
  Description of Artificial Sequence: Synthetic peptide
  XENP024239 vlCDR2
KVSNRFS

SEQ ID NO: 34539 - protein, 9 aa, Artificial Sequence
  Description of Artificial Sequence: Synthetic peptide
  XENP024239 vlCDR3
FQGSHVPNT

SEQ ID NO: 34540 - protein, 251 aa, Artificial Sequence
  Description of Artificial Sequence: Synthetic polypeptide
  XENP024240 1C11_H3.110_L3_scFv
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34541 - protein, 117 aa, Artificial Sequence
  Description of Artificial Sequence: Synthetic polypeptide
  VH of XENP024240
QIQLVQSGSELKKPGASVKVSCKASGGTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34542 - protein, 114 aa, Artificial Sequence; identical to SEQ ID NO: 33651
  Description of Artificial Sequence: Synthetic polypeptide
  VL of XENP024240

SEQ ID NO: 34543 - protein, 5 aa, Artificial Sequence
  Description of Artificial Sequence: Synthetic peptide
  XENP024240 vhCDR1
HYGMN

SEQ ID NO: 34544 - protein, 17 aa, Artificial Sequence
  Description of Artificial Sequence: Synthetic peptide
  XENP024240 vhCDR2
WINTYTGEPTYADGFTG

SEQ ID NO: 34545 - protein, 8 aa, Artificial Sequence
  Description of Artificial Sequence: Synthetic peptide
  XENP024240 vhCDR3
DYYGSSPY

SEQ ID NO: 34546 - protein, 16 aa, Artificial Sequence
  Description of Artificial Sequence: Synthetic peptide
  XENP024240 vlCDR1
KSSQSIVHSNGNTYLE

SEQ ID NO: 34547 - protein, 7 aa, Artificial Sequence
  Description of Artificial Sequence: Synthetic peptide
  XENP024240 vlCDR2
KVSNRFS

SEQ ID NO: 34548 - protein, 9 aa, Artificial Sequence
  Description of Artificial Sequence: Synthetic peptide
  XENP024240 vlCDR3
FQGSHVPNT

SEQ ID NO: 34549 - protein, 251 aa, Artificial Sequence
  Description of Artificial Sequence: Synthetic polypeptide
  XENP024241 1C11_H3.111_L3_scFv
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34550 - protein, 117 aa, Artificial Sequence
  Description of Artificial Sequence: Synthetic polypeptide
  VH of XENP024241
QIQLVQSGSELKKPGASVKVSCKASGYSFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34551 - protein, 114 aa, Artificial Sequence; identical to SEQ ID NO: 33651
  Description of Artificial Sequence: Synthetic polypeptide
  VL of XENP024241

SEQ ID NO: 34552 - protein, 5 aa, Artificial Sequence
  Description of Artificial Sequence: Synthetic peptide
  XENP024241 vhCDR1
HYGMN

SEQ ID NO: 34553 - protein, 17 aa, Artificial Sequence
  Description of Artificial Sequence: Synthetic peptide
  XENP024241 vhCDR2
WINTYTGEPTYADGFTG

SEQ ID NO: 34554 - protein, 8 aa, Artificial Sequence
  Description of Artificial Sequence: Synthetic peptide
  XENP024241 vhCDR3
DYYGSSPY

SEQ ID NO: 34555 - protein, 16 aa, Artificial Sequence
  Description of Artificial Sequence: Synthetic peptide
  XENP024241 vlCDR1
KSSQSIVHSNGNTYLE

SEQ ID NO: 34556 - protein, 7 aa, Artificial Sequence
  Description of Artificial Sequence: Synthetic peptide
  XENP024241 vlCDR2
KVSNRFS

SEQ ID NO: 34557 - protein, 9 aa, Artificial Sequence
  Description of Artificial Sequence: Synthetic peptide
  XENP024241 vlCDR3
FQGSHVPNT

SEQ ID NO: 34558 - protein, 251 aa, Artificial Sequence
  Description of Artificial Sequence: Synthetic polypeptide
  XENP024242 1C11_H3.113_L3_scFv
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34559 - protein, 117 aa, Artificial Sequence
  Description of Artificial Sequence: Synthetic polypeptide
  VH of XENP024242
QIQLVQSGSELKKPGASVKVSCKASGYTITHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34560 - protein, 114 aa, Artificial Sequence; identical to SEQ ID NO: 33651
  Description of Artificial Sequence: Synthetic polypeptide
  VL of XENP024242

SEQ ID NO: 34561 - protein, 5 aa, Artificial Sequence
  Description of Artificial Sequence: Synthetic peptide
  XENP024242 vhCDR1
HYGMN

SEQ ID NO: 34562 - protein, 17 aa, Artificial Sequence
  Description of Artificial Sequence: Synthetic peptide
  XENP024242 vhCDR2
WINTYTGEPTYADGFTG

SEQ ID NO: 34563 - protein, 8 aa, Artificial Sequence
  Description of Artificial Sequence: Synthetic peptide
  XENP024242 vhCDR3
DYYGSSPY

SEQ ID NO: 34564 - protein, 16 aa, Artificial Sequence
  Description of Artificial Sequence: Synthetic peptide
  XENP024242 vlCDR1
KSSQSIVHSNGNTYLE

SEQ ID NO: 34565 - protein, 7 aa, Artificial Sequence
  Description of Artificial Sequence: Synthetic peptide
  XENP024242 vlCDR2
KVSNRFS

SEQ ID NO: 34566 - protein, 9 aa, Artificial Sequence
  Description of Artificial Sequence: Synthetic peptide
  XENP024242 vlCDR3
FQGSHVPNT

SEQ ID NO: 34567 - protein, 251 aa, Artificial Sequence
  Description of Artificial Sequence: Synthetic polypeptide
  XENP024243 1C11_H3.114_L3_scFv
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34568 - protein, 117 aa, Artificial Sequence
  Description of Artificial Sequence: Synthetic polypeptide
  VH of XENP024243
QIQLVQSGSELKKPGASVKVSCKASGYTVTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34569 - protein, 114 aa, Artificial Sequence; identical to SEQ ID NO: 33651
  Description of Artificial Sequence: Synthetic polypeptide
  VL of XENP024243

SEQ ID NO: 34570 - protein, 5 aa, Artificial Sequence
  Description of Artificial Sequence: Synthetic peptide
  XENP024243 vhCDR1
HYGMN

SEQ ID NO: 34571 - protein, 17 aa, Artificial Sequence
  Description of Artificial Sequence: Synthetic peptide
  XENP024243 vhCDR2
WINTYTGEPTYADGFTG

SEQ ID NO: 34572 - protein, 8 aa, Artificial Sequence
  Description of Artificial Sequence: Synthetic peptide
  XENP024243 vhCDR3
DYYGSSPY

SEQ ID NO: 34573 - protein, 16 aa, Artificial Sequence
  Description of Artificial Sequence: Synthetic peptide
  XENP024243 vlCDR1
KSSQSIVHSNGNTYLE

SEQ ID NO: 34574 - protein, 7 aa, Artificial Sequence
  Description of Artificial Sequence: Synthetic peptide
  XENP024243 vlCDR2
KVSNRFS

SEQ ID NO: 34575 - protein, 9 aa, Artificial Sequence
  Description of Artificial Sequence: Synthetic peptide
  XENP024243 vlCDR3
FQGSHVPNT

SEQ ID NO: 34576 - protein, 251 aa, Artificial Sequence
  Description of Artificial Sequence: Synthetic polypeptide
  XENP024244 1C11_H3.115_L3_scFv
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34577 - protein, 117 aa, Artificial Sequence
  Description of Artificial Sequence: Synthetic polypeptide
  VH of XENP024244
QIQLVQSGSELKKPGASVKVSCKASGYTFSHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34578 - protein, 114 aa, Artificial Sequence; identical to SEQ ID NO: 33651
  Description of Artificial Sequence: Synthetic polypeptide
  VL of XENP024244

SEQ ID NO: 34579 - protein, 5 aa, Artificial Sequence
  Description of Artificial Sequence: Synthetic peptide
  XENP024244 vhCDR1
HYGMN

SEQ ID NO: 34580 - protein, 17 aa, Artificial Sequence
  Description of Artificial Sequence: Synthetic peptide
  XENP024244 vhCDR2
WINTYTGEPTYADGFTG

SEQ ID NO: 34581 - protein, 8 aa, Artificial Sequence
  Description of Artificial Sequence: Synthetic peptide
  XENP024244 vhCDR3
DYYGSSPY

SEQ ID NO: 34582 - protein, 16 aa, Artificial Sequence
  Description of Artificial Sequence: Synthetic peptide
  XENP024244 vlCDR1
KSSQSIVHSNGNTYLE

SEQ ID NO: 34583 - protein, 7 aa, Artificial Sequence
  Description of Artificial Sequence: Synthetic peptide
  XENP024244 vlCDR2
KVSNRFS

SEQ ID NO: 34584 - protein, 9 aa, Artificial Sequence
  Description of Artificial Sequence: Synthetic peptide
  XENP024244 vlCDR3
FQGSHVPNT

SEQ ID NO: 34585 - protein, 251 aa, Artificial Sequence
  Description of Artificial Sequence: Synthetic polypeptide
  XENP024245 1C11_H3.116_L3_scFv
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34586 - protein, 117 aa, Artificial Sequence
  Description of Artificial Sequence: Synthetic polypeptide
  VH of XENP024245
QIQLVQSGSELKKPGASVKVSCKASGYTFDHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34587 - protein, 114 aa, Artificial Sequence; identical to SEQ ID NO: 33651
  Description of Artificial Sequence: Synthetic polypeptide
  VL of XENP024245

SEQ ID NO: 34588 - protein, 5 aa, Artificial Sequence
  Description of Artificial Sequence: Synthetic peptide
  XENP024245 vhCDR1
HYGMN

SEQ ID NO: 34589 - protein, 17 aa, Artificial Sequence
  Description of Artificial Sequence: Synthetic peptide
  XENP024245 vhCDR2
WINTYTGEPTYADGFTG

SEQ ID NO: 34590 - protein, 8 aa, Artificial Sequence
  Description of Artificial Sequence: Synthetic peptide
  XENP024245 vhCDR3
DYYGSSPY

SEQ ID NO: 34591 - protein, 16 aa, Artificial Sequence
  Description of Artificial Sequence: Synthetic peptide
  XENP024245 vlCDR1
KSSQSIVHSNGNTYLE

SEQ ID NO: 34592 - protein, 7 aa, Artificial Sequence
  Description of Artificial Sequence: Synthetic peptide
  XENP024245 vlCDR2
KVSNRFS

SEQ ID NO: 34593 - protein, 9 aa, Artificial Sequence
  Description of Artificial Sequence: Synthetic peptide
  XENP024245 vlCDR3
FQGSHVPNT

SEQ ID NO: 34594 - protein, 251 aa, Artificial Sequence
  Description of Artificial Sequence: Synthetic polypeptide
  XENP024246 1C11_H3.117_L3_scFv
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34595 - protein, 117 aa, Artificial Sequence
  Description of Artificial Sequence: Synthetic polypeptide
  VH of XENP024246
QIQLVQSGSELKKPGASVKVSCKASGYTFGHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34596 - protein, 114 aa, Artificial Sequence; identical to SEQ ID NO: 33651
  Description of Artificial Sequence: Synthetic polypeptide
  VL of XENP024246

SEQ ID NO: 34597 - protein, 5 aa, Artificial Sequence
  Description of Artificial Sequence: Synthetic peptide
  XENP024246 vhCDR1
HYGMN

SEQ ID NO: 34598 - protein, 17 aa, Artificial Sequence
  Description of Artificial Sequence: Synthetic peptide
  XENP024246 vhCDR2
WINTYTGEPTYADGFTG

SEQ ID NO: 34599 - protein, 8 aa, Artificial Sequence
  Description of Artificial Sequence: Synthetic peptide
  XENP024246 vhCDR3
DYYGSSPY

SEQ ID NO: 34600 - protein, 16 aa, Artificial Sequence
  Description of Artificial Sequence: Synthetic peptide
  XENP024246 vlCDR1
KSSQSIVHSNGNTYLE

SEQ ID NO: 34601 - protein, 7 aa, Artificial Sequence
  Description of Artificial Sequence: Synthetic peptide
  XENP024246 vlCDR2
KVSNRFS

SEQ ID NO: 34602 - protein, 9 aa, Artificial Sequence
  Description of Artificial Sequence: Synthetic peptide
  XENP024246 vlCDR3
FQGSHVPNT

SEQ ID NO: 34603 - protein, 251 aa, Artificial Sequence
  Description of Artificial Sequence: Synthetic polypeptide
  XENP024247 1C11_H3.120_L3_scFv
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34604 - protein, 117 aa, Artificial Sequence
  Description of Artificial Sequence: Synthetic polypeptide
  VH of XENP024247
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34605 - protein, 114 aa, Artificial Sequence; identical to SEQ ID NO: 33651
  Description of Artificial Sequence: Synthetic polypeptide
  VL of XENP024247

SEQ ID NO: 34606 - protein, 5 aa, Artificial Sequence
  Description of Artificial Sequence: Synthetic peptide
  XENP024247 vhCDR1
HYGIN

SEQ ID NO: 34607 - protein, 17 aa, Artificial Sequence
  Description of Artificial Sequence: Synthetic peptide
  XENP024247 vhCDR2
WINTYTGEPTYADGFTG

SEQ ID NO: 34608 - protein, 8 aa, Artificial Sequence
  Description of Artificial Sequence: Synthetic peptide
  XENP024247 vhCDR3
DYYGSSPY

SEQ ID NO: 34609 - protein, 16 aa, Artificial Sequence
  Description of Artificial Sequence: Synthetic peptide
  XENP024247 vlCDR1
KSSQSIVHSNGNTYLE

SEQ ID NO: 34610 - protein, 7 aa, Artificial Sequence
  Description of Artificial Sequence: Synthetic peptide
  XENP024247 vlCDR2
KVSNRFS

SEQ ID NO: 34611 - protein, 9 aa, Artificial Sequence
  Description of Artificial Sequence: Synthetic peptide
  XENP024247 vlCDR3
FQGSHVPNT

SEQ ID NO: 34612 - protein, 251 aa, Artificial Sequence
  Description of Artificial Sequence: Synthetic polypeptide
  XENP024248 1C11_H3.121_L3_scFv
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34613 - protein, 117 aa, Artificial Sequence
  Description of Artificial Sequence: Synthetic polypeptide
  VH of XENP024248
QIQLVQSGSELKKPGASVKVSCKASGYTFTHYGVNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 34614 - protein, 114 aa, Artificial Sequence; identical to SEQ ID NO: 33651
  Description of Artificial Sequence: Synthetic polypeptide
  VL of XENP024248

SEQ ID NO: 34615 - protein, 5 aa, Artificial Sequence
  Description of Artificial Sequence: Synthetic peptide
  XENP024248 vhCDR1
HYGVN

SEQ ID NO: 34616 - protein, 17 aa, Artificial Sequence
  Description of Artificial Sequence: Synthetic peptide
  XENP024248 vhCDR2
WINTYTGEPTYADGFTG

SEQ ID NO: 34617 - protein, 8 aa, Artificial Sequence
  Description of Artificial Sequence: Synthetic peptide
  XENP024248 vhCDR3
DYYGSSPY

SEQ ID NO: 34618 - protein, 16 aa, Artificial Sequence
  Description of Artificial Sequence: Synthetic peptide
  XENP024248 vlCDR1
KSSQSIVHSNGNTYLE

SEQ ID NO: 34619 - protein, 7 aa, Artificial Sequence
  Description of Artificial Sequence: Synthetic peptide
  XENP024248 vlCDR2
KVSNRFS

SEQ ID NO: 34620 - protein, 9 aa, Artificial Sequence
  Description of Artificial Sequence: Synthetic peptide
  XENP024248 vlCDR3
FQGSHVPNT

SEQ ID NO: 34621 - protein, 251 aa, Artificial Sequence
  Description of Artificial Sequence: Synthetic polypeptide
  XENP024249 1C11_H3.123_L3_scFv
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34622 - protein, 117 aa, Artificial Sequence
  Description of Artificial Sequence: Synthetic polypeptide
  VH of XENP024249
QIQLVQSGSELKKPGASVKVSCKASGYTFTHYGMNWIRQAPGQGLEWMGWINTYTGEPTYADGFTGRFVFSLDTSVSTAYLQISSLKAEDTAVYFCARDYYGSSPYWGQGTLVTVSS

SEQ ID NO: 34623 - protein, 114 aa, Artificial Sequence; identical to SEQ ID NO: 33651
  Description of Artificial Sequence: Synthetic polypeptide
  VL of XENP024249

SEQ ID NO: 34624 - protein, 5 aa, Artificial Sequence
  Description of Artificial Sequence: Synthetic peptide
  XENP024249 vhCDR1
HYGMN

SEQ ID NO: 34625 - protein, 17 aa, Artificial Sequence
  Description of Artificial Sequence: Synthetic peptide
  XENP024249 vhCDR2
WINTYTGEPTYADGFTG

SEQ ID NO: 34626 - protein, 8 aa, Artificial Sequence
  Description of Artificial Sequence: Synthetic peptide
  XENP024249 vhCDR3
DYYGSSPY

SEQ ID NO: 34627 - protein, 16 aa, Artificial Sequence
  Description of Artificial Sequence: Synthetic peptide
  XENP024249 vlCDR1
KSSQSIVHSNGNTYLE

SEQ ID NO: 34628 - protein, 7 aa, Artificial Sequence
  Description of Artificial Sequence: Synthetic peptide
  XENP024249 vlCDR2
KVSNRFS

SEQ ID NO: 34629 - protein, 9 aa, Artificial Sequence
  Description of Artificial Sequence: Synthetic peptide
  XENP024249 vlCDR3
FQGSHVPNT

SEQ ID NO: 34630 - protein, 251 aa, Artificial Sequence
  Description of Artificial Sequence: Synthetic polypeptide
  XENP024250 1C11_H3.125_L3_scFv
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34631 - protein, 117 aa, Artificial Sequence
  Description of Artificial Sequence: Synthetic polypeptide
  VH of XENP024250
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSS

SEQ ID NO: 34632 - protein, 114 aa, Artificial Sequence; identical to SEQ ID NO: 33651
  Description of Artificial Sequence: Synthetic polypeptide
  VL of XENP024250

SEQ ID NO: 34633 - protein, 5 aa, Artificial Sequence
  Description of Artificial Sequence: Synthetic peptide
  XENP024250 vhCDR1
HYGMN

SEQ ID NO: 34634 - protein, 17 aa, Artificial Sequence
  Description of Artificial Sequence: Synthetic peptide
  XENP024250 vhCDR2
WINTYTGEPTYADGFTG

SEQ ID NO: 34635 - protein, 8 aa, Artificial Sequence
  Description of Artificial Sequence: Synthetic peptide
  XENP024250 vhCDR3
DYYGSSPY

SEQ ID NO: 34636 - protein, 16 aa, Artificial Sequence
  Description of Artificial Sequence: Synthetic peptide
  XENP024250 vlCDR1
KSSQSIVHSNGNTYLE

SEQ ID NO: 34637 - protein, 7 aa, Artificial Sequence
  Description of Artificial Sequence: Synthetic peptide
  XENP024250 vlCDR2
KVSNRFS

SEQ ID NO: 34638 - protein, 9 aa, Artificial Sequence
  Description of Artificial Sequence: Synthetic peptide
  XENP024250 vlCDR3
FQGSHVPNT

SEQ ID NO: 34639 - protein, 251 aa, Artificial Sequence
  Description of Artificial Sequence: Synthetic polypeptide
  XENP024251 1C11_H3.126_L3_scFv
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34640 - protein, 117 aa, Artificial Sequence
  Description of Artificial Sequence: Synthetic polypeptide
  VH of XENP024251
QIQLVQSGSELKKPGASVKVSCKASGYTFTHYGMNWVRQATGQGLEWMGWINTYTGEPTYADGFTGRFVFSLDTSVSTAYLQISSLKAEDTAVYFCARDYYGSSPYWGQGTLVTVSS

SEQ ID NO: 34641 - protein, 114 aa, Artificial Sequence; identical to SEQ ID NO: 33651
  Description of Artificial Sequence: Synthetic polypeptide
  VL of XENP024251

SEQ ID NO: 34642 - protein, 5 aa, Artificial Sequence
  Description of Artificial Sequence: Synthetic peptide
  XENP024251 vhCDR1
HYGMN

SEQ ID NO: 34643 - protein, 17 aa, Artificial Sequence
  Description of Artificial Sequence: Synthetic peptide
  XENP024251 vhCDR2
WINTYTGEPTYADGFTG

SEQ ID NO: 34644 - protein, 8 aa, Artificial Sequence
  Description of Artificial Sequence: Synthetic peptide
  XENP024251 vhCDR3
DYYGSSPY

SEQ ID NO: 34645 - protein, 16 aa, Artificial Sequence
  Description of Artificial Sequence: Synthetic peptide
  XENP024251 vlCDR1
KSSQSIVHSNGNTYLE

SEQ ID NO: 34646 - protein, 7 aa, Artificial Sequence
  Description of Artificial Sequence: Synthetic peptide
  XENP024251 vlCDR2
KVSNRFS

SEQ ID NO: 34647 - protein, 9 aa, Artificial Sequence
  Description of Artificial Sequence: Synthetic peptide
  XENP024251 vlCDR3
FQGSHVPNT

SEQ ID NO: 34648 - protein, 251 aa, Artificial Sequence
  Description of Artificial Sequence: Synthetic polypeptide
  XENP024252 1C11_H3.127_L3_scFv
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34649 - protein, 117 aa, Artificial Sequence
  Description of Artificial Sequence: Synthetic polypeptide
  VH of XENP024252
QIQLVQSGSELKKPGASVKVSCKASGYTFTHYGMNWVRQAPGQALEWMGWINTYTGEPTYADGFTGRFVFSLDTSVSTAYLQISSLKAEDTAVYFCARDYYGSSPYWGQGTLVTVSS

SEQ ID NO: 34650 - protein, 114 aa, Artificial Sequence; identical to SEQ ID NO: 33651
  Description of Artificial Sequence: Synthetic polypeptide
  VL of XENP024252

SEQ ID NO: 34651 - protein, 5 aa, Artificial Sequence
  Description of Artificial Sequence: Synthetic peptide
  XENP024252 vhCDR1
HYGMN

SEQ ID NO: 34652 - protein, 17 aa, Artificial Sequence
  Description of Artificial Sequence: Synthetic peptide
  XENP024252 vhCDR2
WINTYTGEPTYADGFTG

SEQ ID NO: 34653 - protein, 8 aa, Artificial Sequence
  Description of Artificial Sequence: Synthetic peptide
  XENP024252 vhCDR3
DYYGSSPY

SEQ ID NO: 34654 - protein, 16 aa, Artificial Sequence
  Description of Artificial Sequence: Synthetic peptide
  XENP024252 vlCDR1
KSSQSIVHSNGNTYLE

SEQ ID NO: 34655 - protein, 7 aa, Artificial Sequence
  Description of Artificial Sequence: Synthetic peptide
  XENP024252 vlCDR2
KVSNRFS

SEQ ID NO: 34656 - protein, 9 aa, Artificial Sequence
  Description of Artificial Sequence: Synthetic peptide
  XENP024252 vlCDR3
FQGSHVPNT

SEQ ID NO: 34657 - protein, 251 aa, Artificial Sequence
  Description of Artificial Sequence: Synthetic polypeptide
  XENP024253 1C11_H3.128_L3_scFv
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34658 - protein, 117 aa, Artificial Sequence
  Description of Artificial Sequence: Synthetic polypeptide
  VH of XENP024253
QIQLVQSGSELKKPGASVKVSCKASGYTFTHYGMNWVRQAPGQGLEWVGWINTYTGEPTYADGFTGRFVFSLDTSVSTAYLQISSLKAEDTAVYFCARDYYGSSPYWGQGTLVTVSS

SEQ ID NO: 34659 - protein, 114 aa, Artificial Sequence; identical to SEQ ID NO: 33651
  Description of Artificial Sequence: Synthetic polypeptide
  VL of XENP024253

SEQ ID NO: 34660 - protein, 5 aa, Artificial Sequence
  Description of Artificial Sequence: Synthetic peptide
  XENP024253 vhCDR1
HYGMN

SEQ ID NO: 34661 - protein, 17 aa, Artificial Sequence
  Description of Artificial Sequence: Synthetic peptide
  XENP024253 vhCDR2
WINTYTGEPTYADGFTG

SEQ ID NO: 34662 - protein, 8 aa, Artificial Sequence
  Description of Artificial Sequence: Synthetic peptide
  XENP024253 vhCDR3
DYYGSSPY

SEQ ID NO: 34663 - protein, 16 aa, Artificial Sequence
  Description of Artificial Sequence: Synthetic peptide
  XENP024253 vlCDR1
KSSQSIVHSNGNTYLE

SEQ ID NO: 34664 - protein, 7 aa, Artificial Sequence
  Description of Artificial Sequence: Synthetic peptide
  XENP024253 vlCDR2
KVSNRFS

SEQ ID NO: 34665 - protein, 9 aa, Artificial Sequence
  Description of Artificial Sequence: Synthetic peptide
  XENP024253 vlCDR3
FQGSHVPNT

SEQ ID NO: 34666 - protein, 251 aa, Artificial Sequence
  Description of Artificial Sequence: Synthetic polypeptide
  XENP024254 1C11_H3.129_L3_scFv
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34667 - protein, 117 aa, Artificial Sequence
  Description of Artificial Sequence: Synthetic polypeptide
  VH of XENP024254
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSS

SEQ ID NO: 34668 - protein, 114 aa, Artificial Sequence; identical to SEQ ID NO: 33651
  Description of Artificial Sequence: Synthetic polypeptide
  VL of XENP024254

SEQ ID NO: 34669 - protein, 5 aa, Artificial Sequence
  Description of Artificial Sequence: Synthetic peptide
  XENP024254 vhCDR1
HYGMN

SEQ ID NO: 34670 - protein, 17 aa, Artificial Sequence
  Description of Artificial Sequence: Synthetic peptide
  XENP024254 vhCDR2
WINTYTGEPTYADGFTG

SEQ ID NO: 34671 - protein, 8 aa, Artificial Sequence
  Description of Artificial Sequence: Synthetic peptide
  XENP024254 vhCDR3
DYYGSSPY

SEQ ID NO: 34672 - protein, 16 aa, Artificial Sequence
  Description of Artificial Sequence: Synthetic peptide
  XENP024254 vlCDR1
KSSQSIVHSNGNTYLE

SEQ ID NO: 34673 - protein, 7 aa, Artificial Sequence
  Description of Artificial Sequence: Synthetic peptide
  XENP024254 vlCDR2
KVSNRFS

SEQ ID NO: 34674 - protein, 9 aa, Artificial Sequence
  Description of Artificial Sequence: Synthetic peptide
  XENP024254 vlCDR3
FQGSHVPNT

SEQ ID NO: 34675 - protein, 251 aa, Artificial Sequence
  Description of Artificial Sequence: Synthetic polypeptide
  XENP024255 1C11_H3.130_L3_scFv
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34676 - protein, 117 aa, Artificial Sequence
  Description of Artificial Sequence: Synthetic polypeptide
  VH of XENP024255
QIQLVQSGSELKKPGASVKVSCKASGYTFTHYGMNWVRQAPGQGLEWMSWINTYTGEPTYADGFTGRFVFSLDTSVSTAYLQISSLKAEDTAVYFCARDYYGSSPYWGQGTLVTVSS

SEQ ID NO: 34677 - protein, 114 aa, Artificial Sequence; identical to SEQ ID NO: 33651
  Description of Artificial Sequence: Synthetic polypeptide
  VL of XENP024255

SEQ ID NO: 34678 - protein, 5 aa, Artificial Sequence
  Description of Artificial Sequence: Synthetic peptide
  XENP024255 vhCDR1
HYGMN

SEQ ID NO: 34679 - protein, 17 aa, Artificial Sequence
  Description of Artificial Sequence: Synthetic peptide
  XENP024255 vhCDR2
WINTYTGEPTYADGFTG

SEQ ID NO: 34680 - protein, 8 aa, Artificial Sequence
  Description of Artificial Sequence: Synthetic peptide
  XENP024255 vhCDR3
DYYGSSPY

SEQ ID NO: 34681 - protein, 16 aa, Artificial Sequence
  Description of Artificial Sequence: Synthetic peptide
  XENP024255 vlCDR1
KSSQSIVHSNGNTYLE

SEQ ID NO: 34682 - protein, 7 aa, Artificial Sequence
  Description of Artificial Sequence: Synthetic peptide
  XENP024255 vlCDR2
KVSNRFS

SEQ ID NO: 34683 - protein, 9 aa, Artificial Sequence
  Description of Artificial Sequence: Synthetic peptide
  XENP024255 vlCDR3
FQGSHVPNT

SEQ ID NO: 34684 - protein, 251 aa, Artificial Sequence
  Description of Artificial Sequence: Synthetic polypeptide
  XENP024256 1C11_H3.134_L3_scFv
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34685 - protein, 117 aa, Artificial Sequence
  Description of Artificial Sequence: Synthetic polypeptide
  VH of XENP024256
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSS

SEQ ID NO: 34686 - protein, 114 aa, Artificial Sequence; identical to SEQ ID NO: 33651
  Description of Artificial Sequence: Synthetic polypeptide
  VL of XENP024256

SEQ ID NO: 34687 - protein, 5 aa, Artificial Sequence
  Description of Artificial Sequence: Synthetic peptide
  XENP024256 vhCDR1
HYGMN

SEQ ID NO: 34688 - protein, 17 aa, Artificial Sequence
  Description of Artificial Sequence: Synthetic peptide
  XENP024256 vhCDR2
WINTKTGEPTYADGFTG

SEQ ID NO: 34689 - protein, 8 aa, Artificial Sequence
  Description of Artificial Sequence: Synthetic peptide
  XENP024256 vhCDR3
DYYGSSPY

SEQ ID NO: 34690 - protein, 16 aa, Artificial Sequence
  Description of Artificial Sequence: Synthetic peptide
  XENP024256 vlCDR1
KSSQSIVHSNGNTYLE

SEQ ID NO: 34691 - protein, 7 aa, Artificial Sequence
  Description of Artificial Sequence: Synthetic peptide
  XENP024256 vlCDR2
KVSNRFS

SEQ ID NO: 34692 - protein, 9 aa, Artificial Sequence
  Description of Artificial Sequence: Synthetic peptide
  XENP024256 vlCDR3
FQGSHVPNT

SEQ ID NO: 34693 - protein, 251 aa, Artificial Sequence
  Description of Artificial Sequence: Synthetic polypeptide
  XENP024257 1C11_H3.135_L3_scFv
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34694 - protein, 117 aa, Artificial Sequence
  Description of Artificial Sequence: Synthetic polypeptide
  VH of XENP024257
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSS

SEQ ID NO: 34695 - protein, 114 aa, Artificial Sequence; identical to SEQ ID NO: 33651
  Description of Artificial Sequence: Synthetic polypeptide
  VL of XENP024257

SEQ ID NO: 34696 - protein, 5 aa, Artificial Sequence
  Description of Artificial Sequence: Synthetic peptide
  XENP024257 vhCDR1
HYGMN

SEQ ID NO: 34697 - protein, 17 aa, Artificial Sequence
  Description of Artificial Sequence: Synthetic peptide
  XENP024257 vhCDR2
WINTYTSEPTYADGFTG

SEQ ID NO: 34698 - protein, 8 aa, Artificial Sequence
  Description of Artificial Sequence: Synthetic peptide
  XENP024257 vhCDR3
DYYGSSPY

SEQ ID NO: 34699 - protein, 16 aa, Artificial Sequence
  Description of Artificial Sequence: Synthetic peptide
  XENP024257 vlCDR1
KSSQSIVHSNGNTYLE

SEQ ID NO: 34700 - protein, 7 aa, Artificial Sequence
  Description of Artificial Sequence: Synthetic peptide
  XENP024257 vlCDR2
KVSNRFS

SEQ ID NO: 34701 - protein, 9 aa, Artificial Sequence
  Description of Artificial Sequence: Synthetic peptide
  XENP024257 vlCDR3
FQGSHVPNT

SEQ ID NO: 34702 - protein, 251 aa, Artificial Sequence
  Description of Artificial Sequence: Synthetic polypeptide
  XENP024258 1C11_H3.136_L3_scFv
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34703 - protein, 117 aa, Artificial Sequence
  Description of Artificial Sequence: Synthetic polypeptide
  VH of XENP024258
QIQLVQSGSELKKPGASVKVSCKASGYTFTHYGMNWVRQAPGQGLEWMGWINTYTGSPTYADGFTGRFVFSLDTSVSTAYLQISSLKAEDTAVYFCARDYYGSSPYWGQGTLVTVSS

SEQ ID NO: 34704 - protein, 114 aa, Artificial Sequence; identical to SEQ ID NO: 33651
  Description of Artificial Sequence: Synthetic polypeptide
  VL of XENP024258

SEQ ID NO: 34705 - protein, 5 aa, Artificial Sequence
  Description of Artificial Sequence: Synthetic peptide
  XENP024258 vhCDR1
HYGMN

SEQ ID NO: 34706 - protein, 17 aa, Artificial Sequence
  Description of Artificial Sequence: Synthetic peptide
  XENP024258 vhCDR2
WINTYTGSPTYADGFTG

SEQ ID NO: 34707 - protein, 8 aa, Artificial Sequence
  Description of Artificial Sequence: Synthetic peptide
  XENP024258 vhCDR3
DYYGSSPY

SEQ ID NO: 34708 - protein, 16 aa, Artificial Sequence
  Description of Artificial Sequence: Synthetic peptide
  XENP024258 vlCDR1
KSSQSIVHSNGNTYLE

SEQ ID NO: 34709 - protein, 7 aa, Artificial Sequence
  Description of Artificial Sequence: Synthetic peptide
  XENP024258 vlCDR2
KVSNRFS

SEQ ID NO: 34710 - protein, 9 aa, Artificial Sequence
  Description of Artificial Sequence: Synthetic peptide
  XENP024258 vlCDR3
FQGSHVPNT

SEQ ID NO: 34711 - protein, 251 aa, Artificial Sequence
  Description of Artificial Sequence: Synthetic polypeptide
  XENP024259 1C11_H3.137_L3_scFv
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34712 - protein, 117 aa, Artificial Sequence
  Description of Artificial Sequence: Synthetic polypeptide
  VH of XENP024259
QIQLVQSGSELKKPGASVKVSCKASGYTFTHYGMNWVRQAPGQGLEWMGWINTYTGNPTYADGFTGRFVFSLDTSVSTAYLQISSLKAEDTAVYFCARDYYGSSPYWGQGTLVTVSS

SEQ ID NO: 34713 - protein, 114 aa, Artificial Sequence; identical to SEQ ID NO: 33651
  Description of Artificial Sequence: Synthetic polypeptide
  VL of XENP024259

SEQ ID NO: 34714 - protein, 5 aa, Artificial Sequence
  Description of Artificial Sequence: Synthetic peptide
  XENP024259 vhCDR1
HYGMN

SEQ ID NO: 34715 - protein, 17 aa, Artificial Sequence
  Description of Artificial Sequence: Synthetic peptide
  XENP024259 vhCDR2
WINTYTGNPTYADGFTG

SEQ ID NO: 34716 - protein, 8 aa, Artificial Sequence
  Description of Artificial Sequence: Synthetic peptide
  XENP024259 vhCDR3
DYYGSSPY

SEQ ID NO: 34717 - protein, 16 aa, Artificial Sequence
  Description of Artificial Sequence: Synthetic peptide
  XENP024259 vlCDR1
KSSQSIVHSNGNTYLE

SEQ ID NO: 34718 - protein, 7 aa, Artificial Sequence
  Description of Artificial Sequence: Synthetic peptide
  XENP024259 vlCDR2
KVSNRFS

SEQ ID NO: 34719 - protein, 9 aa, Artificial Sequence
  Description of Artificial Sequence: Synthetic peptide
  XENP024259 vlCDR3
FQGSHVPNT

SEQ ID NO: 34720 - protein, 251 aa, Artificial Sequence
  Description of Artificial Sequence: Synthetic polypeptide
  XENP024260 1C11_H3.138_L3_scFv
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34721 - protein, 117 aa, Artificial Sequence
  Description of Artificial Sequence: Synthetic polypeptide
  VH of XENP024260
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSS

SEQ ID NO: 34722 - protein, 114 aa, Artificial Sequence; identical to SEQ ID NO: 33651
  Description of Artificial Sequence: Synthetic polypeptide
  VL of XENP024260

SEQ ID NO: 34723 - protein, 5 aa, Artificial Sequence
  Description of Artificial Sequence: Synthetic peptide
  XENP024260 vhCDR1
HYGMN

SEQ ID NO: 34724 - protein, 17 aa, Artificial Sequence
  Description of Artificial Sequence: Synthetic peptide
  XENP024260 vhCDR2
WINTYTGDPTYADGFTG

SEQ ID NO: 34725 - protein, 8 aa, Artificial Sequence
  Description of Artificial Sequence: Synthetic peptide
  XENP024260 vhCDR3
DYYGSSPY

SEQ ID NO: 34726 - protein, 16 aa, Artificial Sequence
  Description of Artificial Sequence: Synthetic peptide
  XENP024260 vlCDR1
KSSQSIVHSNGNTYLE

SEQ ID NO: 34727 - protein, 7 aa, Artificial Sequence
  Description of Artificial Sequence: Synthetic peptide
  XENP024260 vlCDR2
KVSNRFS

SEQ ID NO: 34728 - protein, 9 aa, Artificial Sequence
  Description of Artificial Sequence: Synthetic peptide
  XENP024260 vlCDR3
FQGSHVPNT

SEQ ID NO: 34729 - protein, 251 aa, Artificial Sequence
  Description of Artificial Sequence: Synthetic polypeptide
  XENP024261 1C11_H3.139_L3_scFv
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34730 - protein, 117 aa, Artificial Sequence
  Description of Artificial Sequence: Synthetic polypeptide
  VH of XENP024261
QIQLVQSGSELKKPGASVKVSCKASGYTFTHYGMNWVRQAPGQGLEWMGWINTYTGTPTYADGFTGRFVFSLDTSVSTAYLQISSLKAEDTAVYFCARDYYGSSPYWGQGTLVTVSS

SEQ ID NO: 34731 - protein, 114 aa, Artificial Sequence; identical to SEQ ID NO: 33651
  Description of Artificial Sequence: Synthetic polypeptide
  VL of XENP024261

SEQ ID NO: 34732 - protein, 5 aa, Artificial Sequence
  Description of Artificial Sequence: Synthetic peptide
  XENP024261 vhCDR1
HYGMN

SEQ ID NO: 34733 - protein, 17 aa, Artificial Sequence
  Description of Artificial Sequence: Synthetic peptide
  XENP024261 vhCDR2
WINTYTGTPTYADGFTG

SEQ ID NO: 34734 - protein, 8 aa, Artificial Sequence
  Description of Artificial Sequence: Synthetic peptide
  XENP024261 vhCDR3
DYYGSSPY

SEQ ID NO: 34735 - protein, 16 aa, Artificial Sequence
  Description of Artificial Sequence: Synthetic peptide
  XENP024261 vlCDR1
KSSQSIVHSNGNTYLE

SEQ ID NO: 34736 - protein, 7 aa, Artificial Sequence
  Description of Artificial Sequence: Synthetic peptide
  XENP024261 vlCDR2
KVSNRFS

SEQ ID NO: 34737 - protein, 9 aa, Artificial Sequence
  Description of Artificial Sequence: Synthetic peptide
  XENP024261 vlCDR3
FQGSHVPNT

SEQ ID NO: 34738 - protein, 251 aa, Artificial Sequence
  Description of Artificial Sequence: Synthetic polypeptide
  XENP024262 1C11_H3.140_L3_scFv
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34739 - protein, 117 aa, Artificial Sequence
  Description of Artificial Sequence: Synthetic polypeptide
  VH of XENP024262
QIQLVQSGSELKKPGASVKVSCKASGYTFTHYGMNWVRQAPGQGLEWMGWINTYTGYPTYADGFTGRFVFSLDTSVSTAYLQISSLKAEDTAVYFCARDYYGSSPYWGQGTLVTVSS

SEQ ID NO: 34740 - protein, 114 aa, Artificial Sequence; identical to SEQ ID NO: 33651
  Description of Artificial Sequence: Synthetic polypeptide
  VL of XENP024262

SEQ ID NO: 34741 - protein, 5 aa, Artificial Sequence
  Description of Artificial Sequence: Synthetic peptide
  XENP024262 vhCDR1
HYGMN

SEQ ID NO: 34742 - protein, 17 aa, Artificial Sequence
  Description of Artificial Sequence: Synthetic peptide
  XENP024262 vhCDR2
WINTYTGYPTYADGFTG

SEQ ID NO: 34743 - protein, 8 aa, Artificial Sequence
  Description of Artificial Sequence: Synthetic peptide
  XENP024262 vhCDR3
DYYGSSPY

SEQ ID NO: 34744 - protein, 16 aa, Artificial Sequence
  Description of Artificial Sequence: Synthetic peptide
  XENP024262 vlCDR1
KSSQSIVHSNGNTYLE

SEQ ID NO: 34745 - protein, 7 aa, Artificial Sequence
  Description of Artificial Sequence: Synthetic peptide
  XENP024262 vlCDR2
KVSNRFS

SEQ ID NO: 34746 - protein, 9 aa, Artificial Sequence
  Description of Artificial Sequence: Synthetic peptide
  XENP024262 vlCDR3
FQGSHVPNT

SEQ ID NO: 34747 - protein, 251 aa, Artificial Sequence
  Description of Artificial Sequence: Synthetic polypeptide
  XENP024263 1C11_H3.143_L3_scFv
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34748 - protein, 117 aa, Artificial Sequence
  Description of Artificial Sequence: Synthetic polypeptide
  VH of XENP024263
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSS

SEQ ID NO: 34749 - protein, 114 aa, Artificial Sequence; identical to SEQ ID NO: 33651
  Description of Artificial Sequence: Synthetic polypeptide
  VL of XENP024263

SEQ ID NO: 34750 - protein, 5 aa, Artificial Sequence
  Description of Artificial Sequence: Synthetic peptide
  XENP024263 vhCDR1
HYGMN

SEQ ID NO: 34751 - protein, 17 aa, Artificial Sequence
  Description of Artificial Sequence: Synthetic peptide
  XENP024263 vhCDR2
WINTYTGEPYYADGFTG

SEQ ID NO: 34752 - protein, 8 aa, Artificial Sequence
  Description of Artificial Sequence: Synthetic peptide
  XENP024263 vhCDR3
DYYGSSPY

SEQ ID NO: 34753 - protein, 16 aa, Artificial Sequence
  Description of Artificial Sequence: Synthetic peptide
  XENP024263 vlCDR1
KSSQSIVHSNGNTYLE

SEQ ID NO: 34754 - protein, 7 aa, Artificial Sequence
  Description of Artificial Sequence: Synthetic peptide
  XENP024263 vlCDR2
KVSNRFS

SEQ ID NO: 34755 - protein, 9 aa, Artificial Sequence
  Description of Artificial Sequence: Synthetic peptide
  XENP024263 vlCDR3
FQGSHVPNT

SEQ ID NO: 34756 - protein, 251 aa, Artificial Sequence
  Description of Artificial Sequence: Synthetic polypeptide
  XENP024264 1C11_H3.144_L3_scFv
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34757 - protein, 117 aa, Artificial Sequence
  Description of Artificial Sequence: Synthetic polypeptide
  VH of XENP024264
QIQLVQSGSELKKPGASVKVSCKASGYTFTHYGMNWVRQAPGQGLEWMGWINTYTGEPNYADGFTGRFVFSLDTSVSTAYLQISSLKAEDTAVYFCARDYYGSSPYWGQGTLVTVSS

SEQ ID NO: 34758 - protein, 114 aa, Artificial Sequence; identical to SEQ ID NO: 33651
  Description of Artificial Sequence: Synthetic polypeptide
  VL of XENP024264

SEQ ID NO: 34759 - protein, 5 aa, Artificial Sequence
  Description of Artificial Sequence: Synthetic peptide
  XENP024264 vhCDR1
HYGMN

SEQ ID NO: 34760 - protein, 17 aa, Artificial Sequence
  Description of Artificial Sequence: Synthetic peptide
  XENP024264 vhCDR2
WINTYTGEPNYADGFTG

SEQ ID NO: 34761 - protein, 8 aa, Artificial Sequence
  Description of Artificial Sequence: Synthetic peptide
  XENP024264 vhCDR3
DYYGSSPY

SEQ ID NO: 34762 - protein, 16 aa, Artificial Sequence
  Description of Artificial Sequence: Synthetic peptide
  XENP024264 vlCDR1
KSSQSIVHSNGNTYLE

SEQ ID NO: 34763 - protein, 7 aa, Artificial Sequence
  Description of Artificial Sequence: Synthetic peptide
  XENP024264 vlCDR2
KVSNRFS

SEQ ID NO: 34764 - protein, 9 aa, Artificial Sequence
  Description of Artificial Sequence: Synthetic peptide
  XENP024264 vlCDR3
FQGSHVPNT

SEQ ID NO: 34765 - protein, 251 aa, Artificial Sequence
  Description of Artificial Sequence: Synthetic polypeptide
  XENP024265 1C11_H3.145_L3_scFv
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34766 - protein, 117 aa, Artificial Sequence
  Description of Artificial Sequence: Synthetic polypeptide
  VH of XENP024265
QIQLVQSGSELKKPGASVKVSCKASGYTFTHYGMNWVRQAPGQGLEWMGWINTYTGEPTYSDGFTGRFVFSLDTSVSTAYLQISSLKAEDTAVYFCARDYYGSSPYWGQGTLVTVSS

SEQ ID NO: 34767 - protein, 114 aa, Artificial Sequence; identical to SEQ ID NO: 33651
  Description of Artificial Sequence: Synthetic polypeptide
  VL of XENP024265

SEQ ID NO: 34768 - protein, 5 aa, Artificial Sequence
  Description of Artificial Sequence: Synthetic peptide
  XENP024265 vhCDR1
HYGMN

SEQ ID NO: 34769 - protein, 17 aa, Artificial Sequence
  Description of Artificial Sequence: Synthetic peptide
  XENP024265 vhCDR2
WINTYTGEPTYSDGFTG

SEQ ID NO: 34770 - protein, 8 aa, Artificial Sequence
  Description of Artificial Sequence: Synthetic peptide
  XENP024265 vhCDR3
DYYGSSPY

SEQ ID NO: 34771 - protein, 16 aa, Artificial Sequence
  Description of Artificial Sequence: Synthetic peptide
  XENP024265 vlCDR1
KSSQSIVHSNGNTYLE

SEQ ID NO: 34772 - protein, 7 aa, Artificial Sequence
  Description of Artificial Sequence: Synthetic peptide
  XENP024265 vlCDR2
KVSNRFS

SEQ ID NO: 34773 - protein, 9 aa, Artificial Sequence
  Description of Artificial Sequence: Synthetic peptide
  XENP024265 vlCDR3
FQGSHVPNT

SEQ ID NO: 34774 - protein, 251 aa, Artificial Sequence
  Description of Artificial Sequence: Synthetic polypeptide
  XENP024266 1C11_H3.146_L3_scFv
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34775 - protein, 117 aa, Artificial Sequence
  Description of Artificial Sequence: Synthetic polypeptide
  VH of XENP024266
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSS

SEQ ID NO: 34776 - protein, 114 aa, Artificial Sequence; identical to SEQ ID NO: 33651
  Description of Artificial Sequence: Synthetic polypeptide
  VL of XENP024266

SEQ ID NO: 34777 - protein, 5 aa, Artificial Sequence
  Description of Artificial Sequence: Synthetic peptide
  XENP024266 vhCDR1
HYGMN

SEQ ID NO: 34778 - protein, 17 aa, Artificial Sequence
  Description of Artificial Sequence: Synthetic peptide
  XENP024266 vhCDR2
WINTYTGEPTYAPGFTG

SEQ ID NO: 34779 - protein, 8 aa, Artificial Sequence
  Description of Artificial Sequence: Synthetic peptide
  XENP024266 vhCDR3
DYYGSSPY

SEQ ID NO: 34780 - protein, 16 aa, Artificial Sequence
  Description of Artificial Sequence: Synthetic peptide
  XENP024266 vlCDR1
KSSQSIVHSNGNTYLE

SEQ ID NO: 34781 - protein, 7 aa, Artificial Sequence
  Description of Artificial Sequence: Synthetic peptide
  XENP024266 vlCDR2
KVSNRFS

SEQ ID NO: 34782 - protein, 9 aa, Artificial Sequence
  Description of Artificial Sequence: Synthetic peptide
  XENP024266 vlCDR3
FQGSHVPNT

SEQ ID NO: 34783 - protein, 251 aa, Artificial Sequence
  Description of Artificial Sequence: Synthetic polypeptide
  XENP024267 1C11_H3.147_L3_scFv
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34784 - protein, 117 aa, Artificial Sequence
  Description of Artificial Sequence: Synthetic polypeptide
  VH of XENP024267
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSS

SEQ ID NO: 34785 - protein, 114 aa, Artificial Sequence; identical to SEQ ID NO: 33651
  Description of Artificial Sequence: Synthetic polypeptide
  VL of XENP024267

SEQ ID NO: 34786 - protein, 5 aa, Artificial Sequence
  Description of Artificial Sequence: Synthetic peptide
  XENP024267 vhCDR1
HYGMN

SEQ ID NO: 34787 - protein, 17 aa, Artificial Sequence
  Description of Artificial Sequence: Synthetic peptide
  XENP024267 vhCDR2
WINTYTGEPTYATGFTG

SEQ ID NO: 34788 - protein, 8 aa, Artificial Sequence
  Description of Artificial Sequence: Synthetic peptide
  XENP024267 vhCDR3
DYYGSSPY

SEQ ID NO: 34789 - protein, 16 aa, Artificial Sequence
  Description of Artificial Sequence: Synthetic peptide
  XENP024267 vlCDR1
KSSQSIVHSNGNTYLE

SEQ ID NO: 34790 - protein, 7 aa, Artificial Sequence
  Description of Artificial Sequence: Synthetic peptide
  XENP024267 vlCDR2
KVSNRFS

SEQ ID NO: 34791 - protein, 9 aa, Artificial Sequence
  Description of Artificial Sequence: Synthetic peptide
  XENP024267 vlCDR3
FQGSHVPNT

SEQ ID NO: 34792 - protein, 251 aa, Artificial Sequence
  Description of Artificial Sequence: Synthetic polypeptide
  XENP024268 1C11_H3.148_L3_scFv
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34793 - protein, 117 aa, Artificial Sequence
  Description of Artificial Sequence: Synthetic polypeptide
  VH of XENP024268
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSS

SEQ ID NO: 34794 - protein, 114 aa, Artificial Sequence; identical to SEQ ID NO: 33651
  Description of Artificial Sequence: Synthetic polypeptide
  VL of XENP024268

SEQ ID NO: 34795 - protein, 5 aa, Artificial Sequence
  Description of Artificial Sequence: Synthetic peptide
  XENP024268 vhCDR1
HYGMN

SEQ ID NO: 34796 - protein, 17 aa, Artificial Sequence
  Description of Artificial Sequence: Synthetic peptide
  XENP024268 vhCDR2
WINTYTGEPTYAQKFTG

SEQ ID NO: 34797 - protein, 8 aa, Artificial Sequence
  Description of Artificial Sequence: Synthetic peptide
  XENP024268 vhCDR3
DYYGSSPY

SEQ ID NO: 34798 - protein, 16 aa, Artificial Sequence
  Description of Artificial Sequence: Synthetic peptide
  XENP024268 vlCDR1
KSSQSIVHSNGNTYLE

SEQ ID NO: 34799 - protein, 7 aa, Artificial Sequence
  Description of Artificial Sequence: Synthetic peptide
  XENP024268 vlCDR2
KVSNRFS

SEQ ID NO: 34800 - protein, 9 aa, Artificial Sequence
  Description of Artificial Sequence: Synthetic peptide
  XENP024268 vlCDR3
FQGSHVPNT

SEQ ID NO: 34801 - protein, 251 aa, Artificial Sequence
  Description of Artificial Sequence: Synthetic polypeptide
  XENP024269 1C11_H3.149_L3_scFv
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34802 - protein, 117 aa, Artificial Sequence
  Description of Artificial Sequence: Synthetic polypeptide
  VH of XENP024269
QIQLVQSGSELKKPGASVKVSCKASGYTFTHYGMNWVRQAPGQGLEWMGWINTYTGEPTYADGFTDRFVFSLDTSVSTAYLQISSLKAEDTAVYFCARDYYGSSPYWGQGTLVTVSS

SEQ ID NO: 34803 - protein, 114 aa, Artificial Sequence; identical to SEQ ID NO: 33651
  Description of Artificial Sequence: Synthetic polypeptide
  VL of XENP024269

SEQ ID NO: 34804 - protein, 5 aa, Artificial Sequence
  Description of Artificial Sequence: Synthetic peptide
  XENP024269 vhCDR1
HYGMN

SEQ ID NO: 34805 - protein, 17 aa, Artificial Sequence
  Description of Artificial Sequence: Synthetic peptide
  XENP024269 vhCDR2
WINTYTGEPTYADGFTD

SEQ ID NO: 34806 - protein, 8 aa, Artificial Sequence
  Description of Artificial Sequence: Synthetic peptide
  XENP024269 vhCDR3
DYYGSSPY

SEQ ID NO: 34807 - protein, 16 aa, Artificial Sequence
  Description of Artificial Sequence: Synthetic peptide
  XENP024269 vlCDR1
KSSQSIVHSNGNTYLE

SEQ ID NO: 34808 - protein, 7 aa, Artificial Sequence
  Description of Artificial Sequence: Synthetic peptide
  XENP024269 vlCDR2
KVSNRFS

SEQ ID NO: 34809 - protein, 9 aa, Artificial Sequence
  Description of Artificial Sequence: Synthetic peptide
  XENP024269 vlCDR3
FQGSHVPNT

SEQ ID NO: 34810 - protein, 251 aa, Artificial Sequence
  Description of Artificial Sequence: Synthetic polypeptide
  XENP024270 1C11_H3.150_L3_scFv
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34811 - protein, 117 aa, Artificial Sequence
  Description of Artificial Sequence: Synthetic polypeptide
  VH of XENP024270
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSS

SEQ ID NO: 34812 - protein, 114 aa, Artificial Sequence; identical to SEQ ID NO: 33651
  Description of Artificial Sequence: Synthetic polypeptide
  VL of XENP024270

SEQ ID NO: 34813 - protein, 5 aa, Artificial Sequence
  Description of Artificial Sequence: Synthetic peptide
  XENP024270 vhCDR1
HYGMN

SEQ ID NO: 34814 - protein, 17 aa, Artificial Sequence
  Description of Artificial Sequence: Synthetic peptide
  XENP024270 vhCDR2
WINTYTGEPTYADGFTE

SEQ ID NO: 34815 - protein, 8 aa, Artificial Sequence
  Description of Artificial Sequence: Synthetic peptide
  XENP024270 vhCDR3
DYYGSSPY

SEQ ID NO: 34816 - protein, 16 aa, Artificial Sequence
  Description of Artificial Sequence: Synthetic peptide
  XENP024270 vlCDR1
KSSQSIVHSNGNTYLE

SEQ ID NO: 34817 - protein, 7 aa, Artificial Sequence
  Description of Artificial Sequence: Synthetic peptide
  XENP024270 vlCDR2
KVSNRFS

SEQ ID NO: 34818 - protein, 9 aa, Artificial Sequence
  Description of Artificial Sequence: Synthetic peptide
  XENP024270 vlCDR3
FQGSHVPNT

SEQ ID NO: 34819 - protein, 251 aa, Artificial Sequence
  Description of Artificial Sequence: Synthetic polypeptide
  XENP024271 1C11_H3.151_L3_scFv
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34820 - protein, 117 aa, Artificial Sequence
  Description of Artificial Sequence: Synthetic polypeptide
  VH of XENP024271
QIQLVQSGSELKKPGASVKVSCKASGYTFTHYGMNWVRQAPGQGLEWMGWINTYTGEPTYADGFTSRFVFSLDTSVSTAYLQISSLKAEDTAVYFCARDYYGSSPYWGQGTLVTVSS

SEQ ID NO: 34821 - protein, 114 aa, Artificial Sequence; identical to SEQ ID NO: 33651
  Description of Artificial Sequence: Synthetic polypeptide
  VL of XENP024271

SEQ ID NO: 34822 - protein, 5 aa, Artificial Sequence
  Description of Artificial Sequence: Synthetic peptide
  XENP024271 vhCDR1
HYGMN

SEQ ID NO: 34823 - protein, 17 aa, Artificial Sequence
  Description of Artificial Sequence: Synthetic peptide
  XENP024271 vhCDR2
WINTYTGEPTYADGFTS

SEQ ID NO: 34824 - protein, 8 aa, Artificial Sequence
  Description of Artificial Sequence: Synthetic peptide
  XENP024271 vhCDR3
DYYGSSPY

SEQ ID NO: 34825 - protein, 16 aa, Artificial Sequence
  Description of Artificial Sequence: Synthetic peptide
  XENP024271 vlCDR1
KSSQSIVHSNGNTYLE

SEQ ID NO: 34826 - protein, 7 aa, Artificial Sequence
  Description of Artificial Sequence: Synthetic peptide
  XENP024271 vlCDR2
KVSNRFS

SEQ ID NO: 34827 - protein, 9 aa, Artificial Sequence
  Description of Artificial Sequence: Synthetic peptide
  XENP024271 vlCDR3
FQGSHVPNT

SEQ ID NO: 34828 - protein, 251 aa, Artificial Sequence
  Description of Artificial Sequence: Synthetic polypeptide
  XENP024272 1C11_H3.152_L3_scFv
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34829 - protein, 117 aa, Artificial Sequence
  Description of Artificial Sequence: Synthetic polypeptide
  VH of XENP024272
QIQLVQSGSELKKPGASVKVSCKASGYTFTHYGMNWVRQAPGQGLEWMGWINTYTGEPTYADGFTGRFVFTLDTSVSTAYLQISSLKAEDTAVYFCARDYYGSSPYWGQGTLVTVSS

SEQ ID NO: 34830 - protein, 114 aa, Artificial Sequence; identical to SEQ ID NO: 33651
  Description of Artificial Sequence: Synthetic polypeptide
  VL of XENP024272

SEQ ID NO: 34831 - protein, 5 aa, Artificial Sequence
  Description of Artificial Sequence: Synthetic peptide
  XENP024272 vhCDR1
HYGMN

SEQ ID NO: 34832 - protein, 17 aa, Artificial Sequence
  Description of Artificial Sequence: Synthetic peptide
  XENP024272 vhCDR2
WINTYTGEPTYADGFTG

SEQ ID NO: 34833 - protein, 8 aa, Artificial Sequence
  Description of Artificial Sequence: Synthetic peptide
  XENP024272 vhCDR3
DYYGSSPY

SEQ ID NO: 34834 - protein, 16 aa, Artificial Sequence
  Description of Artificial Sequence: Synthetic peptide
  XENP024272 vlCDR1
KSSQSIVHSNGNTYLE

SEQ ID NO: 34835 - protein, 7 aa, Artificial Sequence
  Description of Artificial Sequence: Synthetic peptide
  XENP024272 vlCDR2
KVSNRFS

SEQ ID NO: 34836 - protein, 9 aa, Artificial Sequence
  Description of Artificial Sequence: Synthetic peptide
  XENP024272 vlCDR3
FQGSHVPNT

SEQ ID NO: 34837 - protein, 251 aa, Artificial Sequence
  Description of Artificial Sequence: Synthetic polypeptide
  XENP024273 1C11_H3.153_L3_scFv
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34838 - protein, 117 aa, Artificial Sequence
  Description of Artificial Sequence: Synthetic polypeptide
  VH of XENP024273
QIQLVQSGSELKKPGASVKVSCKASGYTFTHYGMNWVRQAPGQGLEWMGWINTYTGEPTYADGFTGRFVFSTDTSVSTAYLQISSLKAEDTAVYFCARDYYGSSPYWGQGTLVTVSS

SEQ ID NO: 34839 - protein, 114 aa, Artificial Sequence; identical to SEQ ID NO: 33651
  Description of Artificial Sequence: Synthetic polypeptide
  VL of XENP024273

SEQ ID NO: 34840 - protein, 5 aa, Artificial Sequence
  Description of Artificial Sequence: Synthetic peptide
  XENP024273 vhCDR1
HYGMN

SEQ ID NO: 34841 - protein, 17 aa, Artificial Sequence
  Description of Artificial Sequence: Synthetic peptide
  XENP024273 vhCDR2
WINTYTGEPTYADGFTG

SEQ ID NO: 34842 - protein, 8 aa, Artificial Sequence
  Description of Artificial Sequence: Synthetic peptide
  XENP024273 vhCDR3
DYYGSSPY

SEQ ID NO: 34843 - protein, 16 aa, Artificial Sequence
  Description of Artificial Sequence: Synthetic peptide
  XENP024273 vlCDR1
KSSQSIVHSNGNTYLE

SEQ ID NO: 34844 - protein, 7 aa, Artificial Sequence
  Description of Artificial Sequence: Synthetic peptide
  XENP024273 vlCDR2
KVSNRFS

SEQ ID NO: 34845 - protein, 9 aa, Artificial Sequence
  Description of Artificial Sequence: Synthetic peptide
  XENP024273 vlCDR3
FQGSHVPNT

SEQ ID NO: 34846 - protein, 251 aa, Artificial Sequence
  Description of Artificial Sequence: Synthetic polypeptide
  XENP024274 1C11_H3.154_L3_scFv
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34847 - protein, 117 aa, Artificial Sequence
  Description of Artificial Sequence: Synthetic polypeptide
  VH of XENP024274
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSS

SEQ ID NO: 34848 - protein, 114 aa, Artificial Sequence; identical to SEQ ID NO: 33651
  Description of Artificial Sequence: Synthetic polypeptide
  VL of XENP024274

SEQ ID NO: 34849 - protein, 5 aa, Artificial Sequence
  Description of Artificial Sequence: Synthetic peptide
  XENP024274 vhCDR1
HYGMN

SEQ ID NO: 34850 - protein, 17 aa, Artificial Sequence
  Description of Artificial Sequence: Synthetic peptide
  XENP024274 vhCDR2
WINTYTGEPTYADGFTG

SEQ ID NO: 34851 - protein, 8 aa, Artificial Sequence
  Description of Artificial Sequence: Synthetic peptide
  XENP024274 vhCDR3
DYYGSSPY

SEQ ID NO: 34852 - protein, 16 aa, Artificial Sequence
  Description of Artificial Sequence: Synthetic peptide
  XENP024274 vlCDR1
KSSQSIVHSNGNTYLE

SEQ ID NO: 34853 - protein, 7 aa, Artificial Sequence
  Description of Artificial Sequence: Synthetic peptide
  XENP024274 vlCDR2
KVSNRFS

SEQ ID NO: 34854 - protein, 9 aa, Artificial Sequence
  Description of Artificial Sequence: Synthetic peptide
  XENP024274 vlCDR3
FQGSHVPNT

SEQ ID NO: 34855 - protein, 251 aa, Artificial Sequence
  Description of Artificial Sequence: Synthetic polypeptide
  XENP024275 1C11_H3.155_L3_scFv
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34856 - protein, 117 aa, Artificial Sequence
  Description of Artificial Sequence: Synthetic polypeptide
  VH of XENP024275
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSS

SEQ ID NO: 34857 - protein, 114 aa, Artificial Sequence; identical to SEQ ID NO: 33651
  Description of Artificial Sequence: Synthetic polypeptide
  VL of XENP024275

SEQ ID NO: 34858 - protein, 5 aa, Artificial Sequence
  Description of Artificial Sequence: Synthetic peptide
  XENP024275 vhCDR1
HYGMN

SEQ ID NO: 34859 - protein, 17 aa, Artificial Sequence
  Description of Artificial Sequence: Synthetic peptide
  XENP024275 vhCDR2
WINTYTGEPTYADGFTG

SEQ ID NO: 34860 - protein, 8 aa, Artificial Sequence
  Description of Artificial Sequence: Synthetic peptide
  XENP024275 vhCDR3
DYYGSSPY

SEQ ID NO: 34861 - protein, 16 aa, Artificial Sequence
  Description of Artificial Sequence: Synthetic peptide
  XENP024275 vlCDR1
KSSQSIVHSNGNTYLE

SEQ ID NO: 34862 - protein, 7 aa, Artificial Sequence
  Description of Artificial Sequence: Synthetic peptide
  XENP024275 vlCDR2
KVSNRFS

SEQ ID NO: 34863 - protein, 9 aa, Artificial Sequence
  Description of Artificial Sequence: Synthetic peptide
  XENP024275 vlCDR3
FQGSHVPNT

SEQ ID NO: 34864 - protein, 251 aa, Artificial Sequence
  Description of Artificial Sequence: Synthetic polypeptide
  XENP024276 1C11_H3.156_L3_scFv
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34865 - protein, 117 aa, Artificial Sequence
  Description of Artificial Sequence: Synthetic polypeptide
  VH of XENP024276
QIQLVQSGSELKKPGASVKVSCKASGYTFTHYGMNWVRQAPGQGLEWMGWINTYTGEPTYADGFTGRFVFSLDRSVSTAYLQISSLKAEDTAVYFCARDYYGSSPYWGQGTLVTVSS

SEQ ID NO: 34866 - protein, 114 aa, Artificial Sequence; identical to SEQ ID NO: 33651
  Description of Artificial Sequence: Synthetic polypeptide
  VL of XENP024276

SEQ ID NO: 34867 - protein, 5 aa, Artificial Sequence
  Description of Artificial Sequence: Synthetic peptide
  XENP024276 vhCDR1
HYGMN

SEQ ID NO: 34868 - protein, 17 aa, Artificial Sequence
  Description of Artificial Sequence: Synthetic peptide
  XENP024276 vhCDR2
WINTYTGEPTYADGFTG

SEQ ID NO: 34869 - protein, 8 aa, Artificial Sequence
  Description of Artificial Sequence: Synthetic peptide
  XENP024276 vhCDR3
DYYGSSPY

SEQ ID NO: 34870 - protein, 16 aa, Artificial Sequence
  Description of Artificial Sequence: Synthetic peptide
  XENP024276 vlCDR1
KSSQSIVHSNGNTYLE

SEQ ID NO: 34871 - protein, 7 aa, Artificial Sequence
  Description of Artificial Sequence: Synthetic peptide
  XENP024276 vlCDR2
KVSNRFS

SEQ ID NO: 34872 - protein, 9 aa, Artificial Sequence
  Description of Artificial Sequence: Synthetic peptide
  XENP024276 vlCDR3
FQGSHVPNT

SEQ ID NO: 34873 - protein, 251 aa, Artificial Sequence
  Description of Artificial Sequence: Synthetic polypeptide
  XENP024277 1C11_H3.157_L3_scFv
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34874 - protein, 117 aa, Artificial Sequence
  Description of Artificial Sequence: Synthetic polypeptide
  VH of XENP024277
QIQLVQSGSELKKPGASVKVSCKASGYTFTHYGMNWVRQAPGQGLEWMGWINTYTGEPTYADGFTGRFVFSLDTAVSTAYLQISSLKAEDTAVYFCARDYYGSSPYWGQGTLVTVSS

SEQ ID NO: 34875 - protein, 114 aa, Artificial Sequence; identical to SEQ ID NO: 33651
  Description of Artificial Sequence: Synthetic polypeptide
  VL of XENP024277

SEQ ID NO: 34876 - protein, 5 aa, Artificial Sequence
  Description of Artificial Sequence: Synthetic peptide
  XENP024277 vhCDR1
HYGMN

SEQ ID NO: 34877 - protein, 17 aa, Artificial Sequence
  Description of Artificial Sequence: Synthetic peptide
  XENP024277 vhCDR2
WINTYTGEPTYADGFTG

SEQ ID NO: 34878 - protein, 8 aa, Artificial Sequence
  Description of Artificial Sequence: Synthetic peptide
  XENP024277 vhCDR3
DYYGSSPY

SEQ ID NO: 34879 - protein, 16 aa, Artificial Sequence
  Description of Artificial Sequence: Synthetic peptide
  XENP024277 vlCDR1
KSSQSIVHSNGNTYLE

SEQ ID NO: 34880 - protein, 7 aa, Artificial Sequence
  Description of Artificial Sequence: Synthetic peptide
  XENP024277 vlCDR2
KVSNRFS

SEQ ID NO: 34881 - protein, 9 aa, Artificial Sequence
  Description of Artificial Sequence: Synthetic peptide
  XENP024277 vlCDR3
FQGSHVPNT

SEQ ID NO: 34882 - protein, 251 aa, Artificial Sequence
  Description of Artificial Sequence: Synthetic polypeptide
  XENP024278 1C11_H3.158_L3_scFv
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34883 - protein, 117 aa, Artificial Sequence
  Description of Artificial Sequence: Synthetic polypeptide
  VH of XENP024278
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSS

SEQ ID NO: 34884 - protein, 114 aa, Artificial Sequence; identical to SEQ ID NO: 33651
  Description of Artificial Sequence: Synthetic polypeptide
  VL of XENP024278

SEQ ID NO: 34885 - protein, 5 aa, Artificial Sequence
  Description of Artificial Sequence: Synthetic peptide
  XENP024278 vhCDR1
HYGMN

SEQ ID NO: 34886 - protein, 17 aa, Artificial Sequence
  Description of Artificial Sequence: Synthetic peptide
  XENP024278 vhCDR2
WINTYTGEPTYADGFTG

SEQ ID NO: 34887 - protein, 8 aa, Artificial Sequence
  Description of Artificial Sequence: Synthetic peptide
  XENP024278 vhCDR3
DYYGSSPY

SEQ ID NO: 34888 - protein, 16 aa, Artificial Sequence
  Description of Artificial Sequence: Synthetic peptide
  XENP024278 vlCDR1
KSSQSIVHSNGNTYLE

SEQ ID NO: 34889 - protein, 7 aa, Artificial Sequence
  Description of Artificial Sequence: Synthetic peptide
  XENP024278 vlCDR2
KVSNRFS

SEQ ID NO: 34890 - protein, 9 aa, Artificial Sequence
  Description of Artificial Sequence: Synthetic peptide
  XENP024278 vlCDR3
FQGSHVPNT

SEQ ID NO: 34891 - protein, 251 aa, Artificial Sequence
  Description of Artificial Sequence: Synthetic polypeptide
  XENP024279 1C11_H3.159_L3_scFv
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34892 - protein, 117 aa, Artificial Sequence
  Description of Artificial Sequence: Synthetic polypeptide
  VH of XENP024279
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSS

SEQ ID NO: 34893 - protein, 114 aa, Artificial Sequence; identical to SEQ ID NO: 33651
  Description of Artificial Sequence: Synthetic polypeptide
  VL of XENP024279

SEQ ID NO: 34894 - protein, 5 aa, Artificial Sequence
  Description of Artificial Sequence: Synthetic peptide
  XENP024279 vhCDR1
HYGMN

SEQ ID NO: 34895 - protein, 17 aa, Artificial Sequence
  Description of Artificial Sequence: Synthetic peptide
  XENP024279 vhCDR2
WINTYTGEPTYADGFTG

SEQ ID NO: 34896 - protein, 8 aa, Artificial Sequence
  Description of Artificial Sequence: Synthetic peptide
  XENP024279 vhCDR3
DYYGSSPY

SEQ ID NO: 34897 - protein, 16 aa, Artificial Sequence
  Description of Artificial Sequence: Synthetic peptide
  XENP024279 vlCDR1
KSSQSIVHSNGNTYLE

SEQ ID NO: 34898 - protein, 7 aa, Artificial Sequence
  Description of Artificial Sequence: Synthetic peptide
  XENP024279 vlCDR2
KVSNRFS

SEQ ID NO: 34899 - protein, 9 aa, Artificial Sequence
  Description of Artificial Sequence: Synthetic peptide
  XENP024279 vlCDR3
FQGSHVPNT

SEQ ID NO: 34900 - protein, 251 aa, Artificial Sequence
  Description of Artificial Sequence: Synthetic polypeptide
  XENP024280 1C11_H3.160_L3_scFv
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34901 - protein, 117 aa, Artificial Sequence
  Description of Artificial Sequence: Synthetic polypeptide
  VH of XENP024280
QIQLVQSGSELKKPGASVKVSCKASGYTFTHYGMNWVRQAPGQGLEWMGWINTYTGEPTYADGFTGRFVFSLDTSVSQAYLQISSLKAEDTAVYFCARDYYGSSPYWGQGTLVTVSS

SEQ ID NO: 34902 - protein, 114 aa, Artificial Sequence; identical to SEQ ID NO: 33651
  Description of Artificial Sequence: Synthetic polypeptide
  VL of XENP024280

SEQ ID NO: 34903 - protein, 5 aa, Artificial Sequence
  Description of Artificial Sequence: Synthetic peptide
  XENP024280 vhCDR1
HYGMN

SEQ ID NO: 34904 - protein, 17 aa, Artificial Sequence
  Description of Artificial Sequence: Synthetic peptide
  XENP024280 vhCDR2
WINTYTGEPTYADGFTG

SEQ ID NO: 34905 - protein, 8 aa, Artificial Sequence
  Description of Artificial Sequence: Synthetic peptide
  XENP024280 vhCDR3
DYYGSSPY

SEQ ID NO: 34906 - protein, 16 aa, Artificial Sequence
  Description of Artificial Sequence: Synthetic peptide
  XENP024280 vlCDR1
KSSQSIVHSNGNTYLE

SEQ ID NO: 34907 - protein, 7 aa, Artificial Sequence
  Description of Artificial Sequence: Synthetic peptide
  XENP024280 vlCDR2
KVSNRFS

SEQ ID NO: 34908 - protein, 9 aa, Artificial Sequence
  Description of Artificial Sequence: Synthetic peptide
  XENP024280 vlCDR3
FQGSHVPNT

SEQ ID NO: 34909 - protein, 251 aa, Artificial Sequence
  Description of Artificial Sequence: Synthetic polypeptide
  XENP024281 1C11_H3.161_L3_scFv
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34910 - protein, 117 aa, Artificial Sequence
  Description of Artificial Sequence: Synthetic polypeptide
  VH of XENP024281
QIQLVQSGSELKKPGASVKVSCKASGYTFTHYGMNWVRQAPGQGLEWMGWINTYTGEPTYADGFTGRFVFSLDTSVSSAYLQISSLKAEDTAVYFCARDYYGSSPYWGQGTLVTVSS

SEQ ID NO: 34911 - protein, 114 aa, Artificial Sequence; identical to SEQ ID NO: 33651
  Description of Artificial Sequence: Synthetic polypeptide
  VL of XENP024281

SEQ ID NO: 34912 - protein, 5 aa, Artificial Sequence
  Description of Artificial Sequence: Synthetic peptide
  XENP024281 vhCDR1
HYGMN

SEQ ID NO: 34913 - protein, 17 aa, Artificial Sequence
  Description of Artificial Sequence: Synthetic peptide
  XENP024281 vhCDR2
WINTYTGEPTYADGFTG

SEQ ID NO: 34914 - protein, 8 aa, Artificial Sequence
  Description of Artificial Sequence: Synthetic peptide
  XENP024281 vhCDR3
DYYGSSPY

SEQ ID NO: 34915 - protein, 16 aa, Artificial Sequence
  Description of Artificial Sequence: Synthetic peptide
  XENP024281 vlCDR1
KSSQSIVHSNGNTYLE

SEQ ID NO: 34916 - protein, 7 aa, Artificial Sequence
  Description of Artificial Sequence: Synthetic peptide
  XENP024281 vlCDR2
KVSNRFS

SEQ ID NO: 34917 - protein, 9 aa, Artificial Sequence
  Description of Artificial Sequence: Synthetic peptide
  XENP024281 vlCDR3
FQGSHVPNT

SEQ ID NO: 34918 - protein, 251 aa, Artificial Sequence
  Description of Artificial Sequence: Synthetic polypeptide
  XENP024282 1C11_H3.162_L3_scFv
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34919 - protein, 117 aa, Artificial Sequence
  Description of Artificial Sequence: Synthetic polypeptide
  VH of XENP024282
QIQLVQSGSELKKPGASVKVSCKASGYTFTHYGMNWVRQAPGQGLEWMGWINTYTGEPTYADGFTGRFVFSLDTSVSTLYLQISSLKAEDTAVYFCARDYYGSSPYWGQGTLVTVSS

SEQ ID NO: 34920 - protein, 114 aa, Artificial Sequence; identical to SEQ ID NO: 33651
  Description of Artificial Sequence: Synthetic polypeptide
  VL of XENP024282

SEQ ID NO: 34921 - protein, 5 aa, Artificial Sequence
  Description of Artificial Sequence: Synthetic peptide
  XENP024282 vhCDR1
HYGMN

SEQ ID NO: 34922 - protein, 17 aa, Artificial Sequence
  Description of Artificial Sequence: Synthetic peptide
  XENP024282 vhCDR2
WINTYTGEPTYADGFTG

SEQ ID NO: 34923 - protein, 8 aa, Artificial Sequence
  Description of Artificial Sequence: Synthetic peptide
  XENP024282 vhCDR3
DYYGSSPY

SEQ ID NO: 34924 - protein, 16 aa, Artificial Sequence
  Description of Artificial Sequence: Synthetic peptide
  XENP024282 vlCDR1
KSSQSIVHSNGNTYLE

SEQ ID NO: 34925 - protein, 7 aa, Artificial Sequence
  Description of Artificial Sequence: Synthetic peptide
  XENP024282 vlCDR2
KVSNRFS

SEQ ID NO: 34926 - protein, 9 aa, Artificial Sequence
  Description of Artificial Sequence: Synthetic peptide
  XENP024282 vlCDR3
FQGSHVPNT

SEQ ID NO: 34927 - protein, 251 aa, Artificial Sequence
  Description of Artificial Sequence: Synthetic polypeptide
  XENP024283 1C11_H3.164_L3_scFv
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34928 - protein, 117 aa, Artificial Sequence
  Description of Artificial Sequence: Synthetic polypeptide
  VH of XENP024283
QIQLVQSGSELKKPGASVKVSCKASGYTFTHYGMNWVRQAPGQGLEWMGWINTYTGEPTYADGFTGRFVFSLDTSVSTAVLQISSLKAEDTAVYFCARDYYGSSPYWGQGTLVTVSS

SEQ ID NO: 34929 - protein, 114 aa, Artificial Sequence; identical to SEQ ID NO: 33651
  Description of Artificial Sequence: Synthetic polypeptide
  VL of XENP024283

SEQ ID NO: 34930 - protein, 5 aa, Artificial Sequence
  Description of Artificial Sequence: Synthetic peptide
  XENP024283 vhCDR1
HYGMN

SEQ ID NO: 34931 - protein, 17 aa, Artificial Sequence
  Description of Artificial Sequence: Synthetic peptide
  XENP024283 vhCDR2
WINTYTGEPTYADGFTG

SEQ ID NO: 34932 - protein, 8 aa, Artificial Sequence
  Description of Artificial Sequence: Synthetic peptide
  XENP024283 vhCDR3
DYYGSSPY

SEQ ID NO: 34933 - protein, 16 aa, Artificial Sequence
  Description of Artificial Sequence: Synthetic peptide
  XENP024283 vlCDR1
KSSQSIVHSNGNTYLE

SEQ ID NO: 34934 - protein, 7 aa, Artificial Sequence
  Description of Artificial Sequence: Synthetic peptide
  XENP024283 vlCDR2
KVSNRFS

SEQ ID NO: 34935 - protein, 9 aa, Artificial Sequence
  Description of Artificial Sequence: Synthetic peptide
  XENP024283 vlCDR3
FQGSHVPNT

SEQ ID NO: 34936 - protein, 251 aa, Artificial Sequence
  Description of Artificial Sequence: Synthetic polypeptide
  XENP024284 1C11_H3.165_L3_scFv
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34937 - protein, 117 aa, Artificial Sequence
  Description of Artificial Sequence: Synthetic polypeptide
  VH of XENP024284
QIQLVQSGSELKKPGASVKVSCKASGYTFTHYGMNWVRQAPGQGLEWMGWINTYTGEPTYADGFTGRFVFSLDTSVSTASLQISSLKAEDTAVYFCARDYYGSSPYWGQGTLVTVSS

SEQ ID NO: 34938 - protein, 114 aa, Artificial Sequence; identical to SEQ ID NO: 33651
  Description of Artificial Sequence: Synthetic polypeptide
  VL of XENP024284

SEQ ID NO: 34939 - protein, 5 aa, Artificial Sequence
  Description of Artificial Sequence: Synthetic peptide
  XENP024284 vhCDR1
HYGMN

SEQ ID NO: 34940 - protein, 17 aa, Artificial Sequence
  Description of Artificial Sequence: Synthetic peptide
  XENP024284 vhCDR2
WINTYTGEPTYADGFTG

SEQ ID NO: 34941 - protein, 8 aa, Artificial Sequence
  Description of Artificial Sequence: Synthetic peptide
  XENP024284 vhCDR3
DYYGSSPY

SEQ ID NO: 34942 - protein, 16 aa, Artificial Sequence
  Description of Artificial Sequence: Synthetic peptide
  XENP024284 vlCDR1
KSSQSIVHSNGNTYLE

SEQ ID NO: 34943 - protein, 7 aa, Artificial Sequence
  Description of Artificial Sequence: Synthetic peptide
  XENP024284 vlCDR2
KVSNRFS

SEQ ID NO: 34944 - protein, 9 aa, Artificial Sequence
  Description of Artificial Sequence: Synthetic peptide
  XENP024284 vlCDR3
FQGSHVPNT

SEQ ID NO: 34945 - protein, 251 aa, Artificial Sequence
  Description of Artificial Sequence: Synthetic polypeptide
  XENP024285 1C11_H3.166_L3_scFv
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34946 - protein, 117 aa, Artificial Sequence
  Description of Artificial Sequence: Synthetic polypeptide
  VH of XENP024285
QIQLVQSGSELKKPGASVKVSCKASGYTFTHYGMNWVRQAPGQGLEWMGWINTYTGEPTYADGFTGRFVFSLDTSVSTAYLEISSLKAEDTAVYFCARDYYGSSPYWGQGTLVTVSS

SEQ ID NO: 34947 - protein, 114 aa, Artificial Sequence; identical to SEQ ID NO: 33651
  Description of Artificial Sequence: Synthetic polypeptide
  VL of XENP024285

SEQ ID NO: 34948 - protein, 5 aa, Artificial Sequence
  Description of Artificial Sequence: Synthetic peptide
  XENP024285 vhCDR1
HYGMN

SEQ ID NO: 34949 - protein, 17 aa, Artificial Sequence
  Description of Artificial Sequence: Synthetic peptide
  XENP024285 vhCDR2
WINTYTGEPTYADGFTG

SEQ ID NO: 34950 - protein, 8 aa, Artificial Sequence
  Description of Artificial Sequence: Synthetic peptide
  XENP024285 vhCDR3
DYYGSSPY

SEQ ID NO: 34951 - protein, 16 aa, Artificial Sequence
  Description of Artificial Sequence: Synthetic peptide
  XENP024285 vlCDR1
KSSQSIVHSNGNTYLE

SEQ ID NO: 34952 - protein, 7 aa, Artificial Sequence
  Description of Artificial Sequence: Synthetic peptide
  XENP024285 vlCDR2
KVSNRFS

SEQ ID NO: 34953 - protein, 9 aa, Artificial Sequence
  Description of Artificial Sequence: Synthetic peptide
  XENP024285 vlCDR3
FQGSHVPNT

SEQ ID NO: 34954 - protein, 251 aa, Artificial Sequence
  Description of Artificial Sequence: Synthetic polypeptide
  XENP024286 1C11_H3.167_L3_scFv
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34955 - protein, 117 aa, Artificial Sequence
  Description of Artificial Sequence: Synthetic polypeptide
  VH of XENP024286
QIQLVQSGSELKKPGASVKVSCKASGYTFTHYGMNWVRQAPGQGLEWMGWINTYTGEPTYADGFTGRFVFSLDTSVSTAYLKISSLKAEDTAVYFCARDYYGSSPYWGQGTLVTVSS

SEQ ID NO: 34956 - protein, 114 aa, Artificial Sequence; identical to SEQ ID NO: 33651
  Description of Artificial Sequence: Synthetic polypeptide
  VL of XENP024286

SEQ ID NO: 34957 - protein, 5 aa, Artificial Sequence
  Description of Artificial Sequence: Synthetic peptide
  XENP024286 vhCDR1
HYGMN

SEQ ID NO: 34958 - protein, 17 aa, Artificial Sequence
  Description of Artificial Sequence: Synthetic peptide
  XENP024286 vhCDR2
WINTYTGEPTYADGFTG

SEQ ID NO: 34959 - protein, 8 aa, Artificial Sequence
  Description of Artificial Sequence: Synthetic peptide
  XENP024286 vhCDR3
DYYGSSPY

SEQ ID NO: 34960 - protein, 16 aa, Artificial Sequence
  Description of Artificial Sequence: Synthetic peptide
  XENP024286 vlCDR1
KSSQSIVHSNGNTYLE

SEQ ID NO: 34961 - protein, 7 aa, Artificial Sequence
  Description of Artificial Sequence: Synthetic peptide
  XENP024286 vlCDR2
KVSNRFS

SEQ ID NO: 34962 - protein, 9 aa, Artificial Sequence
  Description of Artificial Sequence: Synthetic peptide
  XENP024286 vlCDR3
FQGSHVPNT

SEQ ID NO: 34963 - protein, 251 aa, Artificial Sequence
  Description of Artificial Sequence: Synthetic polypeptide
  XENP024287 1C11_H3.168_L3_scFv
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34964 - protein, 117 aa, Artificial Sequence
  Description of Artificial Sequence: Synthetic polypeptide
  VH of XENP024287
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSS

SEQ ID NO: 34965 - protein, 114 aa, Artificial Sequence; identical to SEQ ID NO: 33651
  Description of Artificial Sequence: Synthetic polypeptide
  VL of XENP024287

SEQ ID NO: 34966 - protein, 5 aa, Artificial Sequence
  Description of Artificial Sequence: Synthetic peptide
  XENP024287 vhCDR1
HYGMN

SEQ ID NO: 34967 - protein, 17 aa, Artificial Sequence
  Description of Artificial Sequence: Synthetic peptide
  XENP024287 vhCDR2
WINTYTGEPTYADGFTG

SEQ ID NO: 34968 - protein, 8 aa, Artificial Sequence
  Description of Artificial Sequence: Synthetic peptide
  XENP024287 vhCDR3
DYYGSSPY

SEQ ID NO: 34969 - protein, 16 aa, Artificial Sequence
  Description of Artificial Sequence: Synthetic peptide
  XENP024287 vlCDR1
KSSQSIVHSNGNTYLE

SEQ ID NO: 34970 - protein, 7 aa, Artificial Sequence
  Description of Artificial Sequence: Synthetic peptide
  XENP024287 vlCDR2
KVSNRFS

SEQ ID NO: 34971 - protein, 9 aa, Artificial Sequence
  Description of Artificial Sequence: Synthetic peptide
  XENP024287 vlCDR3
FQGSHVPNT

SEQ ID NO: 34972 - protein, 251 aa, Artificial Sequence
  Description of Artificial Sequence: Synthetic polypeptide
  XENP024288 1C11_H3.169_L3_scFv
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34973 - protein, 117 aa, Artificial Sequence
  Description of Artificial Sequence: Synthetic polypeptide
  VH of XENP024288
QIQLVQSGSELKKPGASVKVSCKASGYTFTHYGMNWVRQAPGQGLEWMGWINTYTGEPTYADGFTGRFVFSLDTSVSTAYLQISSVKAEDTAVYFCARDYYGSSPYWGQGTLVTVSS

SEQ ID NO: 34974 - protein, 114 aa, Artificial Sequence; identical to SEQ ID NO: 33651
  Description of Artificial Sequence: Synthetic polypeptide
  VL of XENP024288

SEQ ID NO: 34975 - protein, 5 aa, Artificial Sequence
  Description of Artificial Sequence: Synthetic peptide
  XENP024288 vhCDR1
HYGMN

SEQ ID NO: 34976 - protein, 17 aa, Artificial Sequence
  Description of Artificial Sequence: Synthetic peptide
  XENP024288 vhCDR2
WINTYTGEPTYADGFTG

SEQ ID NO: 34977 - protein, 8 aa, Artificial Sequence
  Description of Artificial Sequence: Synthetic peptide
  XENP024288 vhCDR3
DYYGSSPY

SEQ ID NO: 34978 - protein, 16 aa, Artificial Sequence
  Description of Artificial Sequence: Synthetic peptide
  XENP024288 vlCDR1
KSSQSIVHSNGNTYLE

SEQ ID NO: 34979 - protein, 7 aa, Artificial Sequence
  Description of Artificial Sequence: Synthetic peptide
  XENP024288 vlCDR2
KVSNRFS

SEQ ID NO: 34980 - protein, 9 aa, Artificial Sequence
  Description of Artificial Sequence: Synthetic peptide
  XENP024288 vlCDR3
FQGSHVPNT

SEQ ID NO: 34981 - protein, 251 aa, Artificial Sequence
  Description of Artificial Sequence: Synthetic polypeptide
  XENP024289 1C11_H3.170_L3_scFv
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34982 - protein, 117 aa, Artificial Sequence
  Description of Artificial Sequence: Synthetic polypeptide
  VH of XENP024289
QIQLVQSGSELKKPGASVKVSCKASGYTFTHYGMNWVRQAPGQGLEWMGWINTYTGEPTYADGFTGRFVFSLDTSVSTAYLQISSMKAEDTAVYFCARDYYGSSPYWGQGTLVTVSS

SEQ ID NO: 34983 - protein, 114 aa, Artificial Sequence; identical to SEQ ID NO: 33651
  Description of Artificial Sequence: Synthetic polypeptide
  VL of XENP024289

SEQ ID NO: 34984 - protein, 5 aa, Artificial Sequence
  Description of Artificial Sequence: Synthetic peptide
  XENP024289 vhCDR1
HYGMN

SEQ ID NO: 34985 - protein, 17 aa, Artificial Sequence
  Description of Artificial Sequence: Synthetic peptide
  XENP024289 vhCDR2
WINTYTGEPTYADGFTG

SEQ ID NO: 34986 - protein, 8 aa, Artificial Sequence
  Description of Artificial Sequence: Synthetic peptide
  XENP024289 vhCDR3
DYYGSSPY

SEQ ID NO: 34987 - protein, 16 aa, Artificial Sequence
  Description of Artificial Sequence: Synthetic peptide
  XENP024289 vlCDR1
KSSQSIVHSNGNTYLE

SEQ ID NO: 34988 - protein, 7 aa, Artificial Sequence
  Description of Artificial Sequence: Synthetic peptide
  XENP024289 vlCDR2
KVSNRFS

SEQ ID NO: 34989 - protein, 9 aa, Artificial Sequence
  Description of Artificial Sequence: Synthetic peptide
  XENP024289 vlCDR3
FQGSHVPNT

SEQ ID NO: 34990 - protein, 251 aa, Artificial Sequence
  Description of Artificial Sequence: Synthetic polypeptide
  XENP024290 1C11_H3.171_L3_scFv
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 34991 - protein, 117 aa, Artificial Sequence
  Description of Artificial Sequence: Synthetic polypeptide
  VH of XENP024290
QIQLVQSGSELKKPGASVKVSCKASGYTFTHYGMNWVRQAPGQGLEWMGWINTYTGEPTYADGFTGRFVFSLDTSVSTAYLQISSLKSEDTAVYFCARDYYGSSPYWGQGTLVTVSS

SEQ ID NO: 34992 - protein, 114 aa, Artificial Sequence; identical to SEQ ID NO: 33651
  Description of Artificial Sequence: Synthetic polypeptide
  VL of XENP024290

SEQ ID NO: 34993 - protein, 5 aa, Artificial Sequence
  Description of Artificial Sequence: Synthetic peptide
  XENP024290 vhCDR1
HYGMN

SEQ ID NO: 34994 - protein, 17 aa, Artificial Sequence
  Description of Artificial Sequence: Synthetic peptide
  XENP024290 vhCDR2
WINTYTGEPTYADGFTG

SEQ ID NO: 34995 - protein, 8 aa, Artificial Sequence
  Description of Artificial Sequence: Synthetic peptide
  XENP024290 vhCDR3
DYYGSSPY

SEQ ID NO: 34996 - protein, 16 aa, Artificial Sequence
  Description of Artificial Sequence: Synthetic peptide
  XENP024290 vlCDR1
KSSQSIVHSNGNTYLE

SEQ ID NO: 34997 - protein, 7 aa, Artificial Sequence
  Description of Artificial Sequence: Synthetic peptide
  XENP024290 vlCDR2
KVSNRFS

SEQ ID NO: 34998 - protein, 9 aa, Artificial Sequence
  Description of Artificial Sequence: Synthetic peptide
  XENP024290 vlCDR3
FQGSHVPNT

SEQ ID NO: 34999 - protein, 251 aa, Artificial Sequence
  Description of Artificial Sequence: Synthetic polypeptide
  XENP024291 1C11_H3.172_L3_scFv
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35000 - protein, 117 aa, Artificial Sequence
  Description of Artificial Sequence: Synthetic polypeptide
  VH of XENP024291
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSS

SEQ ID NO: 35001 - protein, 114 aa, Artificial Sequence; identical to SEQ ID NO: 33651
  Description of Artificial Sequence: Synthetic polypeptide
  VL of XENP024291

SEQ ID NO: 35002 - protein, 5 aa, Artificial Sequence
  Description of Artificial Sequence: Synthetic peptide
  XENP024291 vhCDR1
HYGMN

SEQ ID NO: 35003 - protein, 17 aa, Artificial Sequence
  Description of Artificial Sequence: Synthetic peptide
  XENP024291 vhCDR2
WINTYTGEPTYADGFTG

SEQ ID NO: 35004 - protein, 8 aa, Artificial Sequence
  Description of Artificial Sequence: Synthetic peptide
  XENP024291 vhCDR3
DYYGSSPY

SEQ ID NO: 35005 - protein, 16 aa, Artificial Sequence
  Description of Artificial Sequence: Synthetic peptide
  XENP024291 vlCDR1
KSSQSIVHSNGNTYLE

SEQ ID NO: 35006 - protein, 7 aa, Artificial Sequence
  Description of Artificial Sequence: Synthetic peptide
  XENP024291 vlCDR2
KVSNRFS

SEQ ID NO: 35007 - protein, 9 aa, Artificial Sequence
  Description of Artificial Sequence: Synthetic peptide
  XENP024291 vlCDR3
FQGSHVPNT

SEQ ID NO: 35008 - protein, 251 aa, Artificial Sequence
  Description of Artificial Sequence: Synthetic polypeptide
  XENP024292 1C11_H3.173_L3_scFv
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35009 - protein, 117 aa, Artificial Sequence
  Description of Artificial Sequence: Synthetic polypeptide
  VH of XENP024292
QIQLVQSGSELKKPGASVKVSCKASGYTFTHYGMNWVRQAPGQGLEWMGWINTYTGEPTYADGFTGRFVFSLDTSVSTAYLQISSLKADDTAVYFCARDYYGSSPYWGQGTLVTVSS

SEQ ID NO: 35010 - protein, 114 aa, Artificial Sequence; identical to SEQ ID NO: 33651
  Description of Artificial Sequence: Synthetic polypeptide
  VL of XENP024292

SEQ ID NO: 35011 - protein, 5 aa, Artificial Sequence
  Description of Artificial Sequence: Synthetic peptide
  XENP024292 vhCDR1
HYGMN

SEQ ID NO: 35012 - protein, 17 aa, Artificial Sequence
  Description of Artificial Sequence: Synthetic peptide
  XENP024292 vhCDR2
WINTYTGEPTYADGFTG

SEQ ID NO: 35013 - protein, 8 aa, Artificial Sequence
  Description of Artificial Sequence: Synthetic peptide
  XENP024292 vhCDR3
DYYGSSPY

SEQ ID NO: 35014 - protein, 16 aa, Artificial Sequence
  Description of Artificial Sequence: Synthetic peptide
  XENP024292 vlCDR1
KSSQSIVHSNGNTYLE

SEQ ID NO: 35015 - protein, 7 aa, Artificial Sequence
  Description of Artificial Sequence: Synthetic peptide
  XENP024292 vlCDR2
KVSNRFS

SEQ ID NO: 35016 - protein, 9 aa, Artificial Sequence
  Description of Artificial Sequence: Synthetic peptide
  XENP024292 vlCDR3
FQGSHVPNT

SEQ ID NO: 35017 - protein, 251 aa, Artificial Sequence
  Description of Artificial Sequence: Synthetic polypeptide
  XENP024293 1C11_H3.174_L3_scFv
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35018 - protein, 117 aa, Artificial Sequence
  Description of Artificial Sequence: Synthetic polypeptide
  VH of XENP024293
QIQLVQSGSELKKPGASVKVSCKASGYTFTHYGMNWVRQAPGQGLEWMGWINTYTGEPTYADGFTGRFVFSLDTSVSTAYLQISSLKAADTAVYFCARDYYGSSPYWGQGTLVTVSS

SEQ ID NO: 35019 - protein, 114 aa, Artificial Sequence; identical to SEQ ID NO: 33651
  Description of Artificial Sequence: Synthetic polypeptide
  VL of XENP024293

SEQ ID NO: 35020 - protein, 5 aa, Artificial Sequence
  Description of Artificial Sequence: Synthetic peptide
  XENP024293 vhCDR1
HYGMN

SEQ ID NO: 35021 - protein, 17 aa, Artificial Sequence
  Description of Artificial Sequence: Synthetic peptide
  XENP024293 vhCDR2
WINTYTGEPTYADGFTG

SEQ ID NO: 35022 - protein, 8 aa, Artificial Sequence
  Description of Artificial Sequence: Synthetic peptide
  XENP024293 vhCDR3
DYYGSSPY

SEQ ID NO: 35023 - protein, 16 aa, Artificial Sequence
  Description of Artificial Sequence: Synthetic peptide
  XENP024293 vlCDR1
KSSQSIVHSNGNTYLE

SEQ ID NO: 35024 - protein, 7 aa, Artificial Sequence
  Description of Artificial Sequence: Synthetic peptide
  XENP024293 vlCDR2
KVSNRFS

SEQ ID NO: 35025 - protein, 9 aa, Artificial Sequence
  Description of Artificial Sequence: Synthetic peptide
  XENP024293 vlCDR3
FQGSHVPNT

SEQ ID NO: 35026 - protein, 251 aa, Artificial Sequence
  Description of Artificial Sequence: Synthetic polypeptide
  XENP024372 1C11_H3_L3.86_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 35027 - protein, 117 aa, Artificial Sequence; identical to SEQ ID NO: 33034
  Description of Artificial Sequence: Synthetic polypeptide
  VH of XENP024372

SEQ ID NO: 35028 - protein, 114 aa, Artificial Sequence
  Description of Artificial Sequence: Synthetic polypeptide
  VL of XENP024372
DVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIKGS

SEQ ID NO: 35029 - protein, 5 aa, Artificial Sequence
  Description of Artificial Sequence: Synthetic peptide
  XENP024372 vhCDR1
HYGMN

SEQ ID NO: 35030 - protein, 17 aa, Artificial Sequence
  Description of Artificial Sequence: Synthetic peptide
  XENP024372 vhCDR2
WINTYTGEPTYADGFTG

SEQ ID NO: 35031 - protein, 8 aa, Artificial Sequence
  Description of Artificial Sequence: Synthetic peptide
  XENP024372 vhCDR3
DYYGSSPY

SEQ ID NO: 35032 - protein, 16 aa, Artificial Sequence
  Description of Artificial Sequence: Synthetic peptide
  XENP024372 vlCDR1
KSSQSIVHSNGNTYLE

SEQ ID NO: 35033 - protein, 7 aa, Artificial Sequence
  Description of Artificial Sequence: Synthetic peptide
  XENP024372 vlCDR2
KVSNRFT

SEQ ID NO: 35034 - protein, 9 aa, Artificial Sequence
  Description of Artificial Sequence: Synthetic peptide
  XENP024372 vlCDR3
FQGSHVPNT

SEQ ID NO: 35035 - protein, 251 aa, Artificial Sequence
  Description of Artificial Sequence: Synthetic polypeptide
  XENP024373 1C11_H3_L3.87_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 35036 - protein, 117 aa, Artificial Sequence; identical to SEQ ID NO: 33034
  Description of Artificial Sequence: Synthetic polypeptide
  VH of XENP024373

SEQ ID NO: 35037 - protein, 114 aa, Artificial Sequence
  Description of Artificial Sequence: Synthetic polypeptide
  VL of XENP024373
DVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIKGS

SEQ ID NO: 35038 - protein, 5 aa, Artificial Sequence
  Description of Artificial Sequence: Synthetic peptide
  XENP024373 vhCDR1
HYGMN

SEQ ID NO: 35039 - protein, 17 aa, Artificial Sequence
  Description of Artificial Sequence: Synthetic peptide
  XENP024373 vhCDR2
WINTYTGEPTYADGFTG

SEQ ID NO: 35040 - protein, 8 aa, Artificial Sequence
  Description of Artificial Sequence: Synthetic peptide
  XENP024373 vhCDR3
DYYGSSPY

SEQ ID NO: 35041 - protein, 16 aa, Artificial Sequence
  Description of Artificial Sequence: Synthetic peptide
  XENP024373 vlCDR1
KASQSIVHSNGNTYLE

SEQ ID NO: 35042 - protein, 7 aa, Artificial Sequence
  Description of Artificial Sequence: Synthetic peptide
  XENP024373 vlCDR2
KVSNRFS

SEQ ID NO: 35043 - protein, 9 aa, Artificial Sequence
  Description of Artificial Sequence: Synthetic peptide
  XENP024373 vlCDR3
FQGSHVPNT

SEQ ID NO: 35044 - protein, 251 aa, Artificial Sequence
  Description of Artificial Sequence: Synthetic polypeptide
  XENP024374 1C11_H3_L3.90_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35045 - protein, 117 aa, Artificial Sequence; identical to SEQ ID NO: 33034
  Description of Artificial Sequence: Synthetic polypeptide
  VH of XENP024374

SEQ ID NO: 35046 - protein, 114 aa, Artificial Sequence
  Description of Artificial Sequence: Synthetic polypeptide
  VL of XENP024374
DVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35047 - protein, 5 aa, Artificial Sequence
  Description of Artificial Sequence: Synthetic peptide
  XENP024374 vhCDR1
HYGMN

SEQ ID NO: 35048 - protein, 17 aa, Artificial Sequence
  Description of Artificial Sequence: Synthetic peptide
  XENP024374 vhCDR2
WINTYTGEPTYADGFTG

SEQ ID NO: 35049 - protein, 8 aa, Artificial Sequence
  Description of Artificial Sequence: Synthetic peptide
  XENP024374 vhCDR3
DYYGSSPY

SEQ ID NO: 35050 - protein, 16 aa, Artificial Sequence
  Description of Artificial Sequence: Synthetic peptide
  XENP024374 vlCDR1
KASQSIVHSNGNTYLE

SEQ ID NO: 35051 - protein, 7 aa, Artificial Sequence
  Description of Artificial Sequence: Synthetic peptide
  XENP024374 vlCDR2
KVSNRFS

SEQ ID NO: 35052 - protein, 9 aa, Artificial Sequence
  Description of Artificial Sequence: Synthetic peptide
  XENP024374 vlCDR3
FQGSHVPNT

SEQ ID NO: 35053 - protein, 251 aa, Artificial Sequence
  Description of Artificial Sequence: Synthetic polypeptide
  XENP024375 1C11_H3_L3.92_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35054 - protein, 117 aa, Artificial Sequence; identical to SEQ ID NO: 33034
  Description of Artificial Sequence: Synthetic polypeptide
  VH of XENP024375

SEQ ID NO: 35055 - protein, 114 aa, Artificial Sequence
  Description of Artificial Sequence: Synthetic polypeptide
  VL of XENP024375
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35056 - protein, 5 aa, Artificial Sequence
  Description of Artificial Sequence: Synthetic peptide
  XENP024375 vhCDR1
HYGMN

SEQ ID NO: 35057 - protein, 17 aa, Artificial Sequence
  Description of Artificial Sequence: Synthetic peptide
  XENP024375 vhCDR2
WINTYTGEPTYADGFTG

SEQ ID NO: 35058 - protein, 8 aa, Artificial Sequence
  Description of Artificial Sequence: Synthetic peptide
  XENP024375 vhCDR3
DYYGSSPY

SEQ ID NO: 35059 - protein, 16 aa, Artificial Sequence
  Description of Artificial Sequence: Synthetic peptide
  XENP024375 vlCDR1
KASQSIVHSNGNTYLE

SEQ ID NO: 35060 - protein, 7 aa, Artificial Sequence
  Description of Artificial Sequence: Synthetic peptide
  XENP024375 vlCDR2
KVSNRFT

SEQ ID NO: 35061 - protein, 9 aa, Artificial Sequence
  Description of Artificial Sequence: Synthetic peptide
  XENP024375 vlCDR3
FQGSHVPNT

SEQ ID NO: 35062 - protein, 251 aa, Artificial Sequence
  Description of Artificial Sequence: Synthetic polypeptide
  XENP024376 1C11_H3_L3.94_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35063 - protein, 117 aa, Artificial Sequence; identical to SEQ ID NO: 33034
  Description of Artificial Sequence: Synthetic polypeptide
  VH of XENP024376

SEQ ID NO: 35064 - protein, 114 aa, Artificial Sequence
  Description of Artificial Sequence: Synthetic polypeptide
  VL of XENP024376
DILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35065 - protein, 5 aa, Artificial Sequence
  Description of Artificial Sequence: Synthetic peptide
  XENP024376 vhCDR1
HYGMN

SEQ ID NO: 35066 - protein, 17 aa, Artificial Sequence
  Description of Artificial Sequence: Synthetic peptide
  XENP024376 vhCDR2
WINTYTGEPTYADGFTG

SEQ ID NO: 35067 - protein, 8 aa, Artificial Sequence
  Description of Artificial Sequence: Synthetic peptide
  XENP024376 vhCDR3
DYYGSSPY

SEQ ID NO: 35068 - protein, 16 aa, Artificial Sequence
  Description of Artificial Sequence: Synthetic peptide
  XENP024376 vlCDR1
KSSQSIVHSNGNTYLE

SEQ ID NO: 35069 - protein, 7 aa, Artificial Sequence
  Description of Artificial Sequence: Synthetic peptide
  XENP024376 vlCDR2
KVSNRFT

SEQ ID NO: 35070 - protein, 9 aa, Artificial Sequence
  Description of Artificial Sequence: Synthetic peptide
  XENP024376 vlCDR3
FQGSHVPNT

SEQ ID NO: 35071 - protein, 251 aa, Artificial Sequence
  Description of Artificial Sequence: Synthetic polypeptide
  XENP024377 1C11_H3_L3.96_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35072 - protein, 117 aa, Artificial Sequence; identical to SEQ ID NO: 33034
  Description of Artificial Sequence: Synthetic polypeptide
  VH of XENP024377

SEQ ID NO: 35073 - protein, 114 aa, Artificial Sequence
  Description of Artificial Sequence: Synthetic polypeptide
  VL of XENP024377
DIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35074 - protein, 5 aa, Artificial Sequence
  Description of Artificial Sequence: Synthetic peptide
  XENP024377 vhCDR1
HYGMN

SEQ ID NO: 35075 - protein, 17 aa, Artificial Sequence
  Description of Artificial Sequence: Synthetic peptide
  XENP024377 vhCDR2
WINTYTGEPTYADGFTG

SEQ ID NO: 35076 - protein, 8 aa, Artificial Sequence
  Description of Artificial Sequence: Synthetic peptide
  XENP024377 vhCDR3
DYYGSSPY

SEQ ID NO: 35077 - protein, 16 aa, Artificial Sequence
  Description of Artificial Sequence: Synthetic peptide
  XENP024377 vlCDR1
KASQSIVHSNGNTYLE

SEQ ID NO: 35078 - protein, 7 aa, Artificial Sequence
  Description of Artificial Sequence: Synthetic peptide
  XENP024377 vlCDR2
KVSNRFT

SEQ ID NO: 35079 - protein, 9 aa, Artificial Sequence
  Description of Artificial Sequence: Synthetic peptide
  XENP024377 vlCDR3
FQGSHVPNT

SEQ ID NO: 35080 - protein, 251 aa, Artificial Sequence
  Description of Artificial Sequence: Synthetic polypeptide
  XENP024378 1C11_H3_L3.105_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35081 - protein, 117 aa, Artificial Sequence; identical to SEQ ID NO: 33034
  Description of Artificial Sequence: Synthetic polypeptide
  VH of XENP024378

SEQ ID NO: 35082 - protein, 114 aa, Artificial Sequence
  Description of Artificial Sequence: Synthetic polypeptide
  VL of XENP024378
DVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35083 - protein, 5 aa, Artificial Sequence
  Description of Artificial Sequence: Synthetic peptide
  XENP024378 vhCDR1
HYGMN

SEQ ID NO: 35084 - protein, 17 aa, Artificial Sequence
  Description of Artificial Sequence: Synthetic peptide
  XENP024378 vhCDR2
WINTYTGEPTYADGFTG

SEQ ID NO: 35085 - protein, 8 aa, Artificial Sequence
  Description of Artificial Sequence: Synthetic peptide
  XENP024378 vhCDR3
DYYGSSPY

SEQ ID NO: 35086 - protein, 16 aa, Artificial Sequence
  Description of Artificial Sequence: Synthetic peptide
  XENP024378 vlCDR1
KSSQSIVHSNGNTYLE

SEQ ID NO: 35087 - protein, 7 aa, Artificial Sequence
  Description of Artificial Sequence: Synthetic peptide
  XENP024378 vlCDR2
KVSNRFS

SEQ ID NO: 35088 - protein, 9 aa, Artificial Sequence
  Description of Artificial Sequence: Synthetic peptide
  XENP024378 vlCDR3
FQGSHVPNT

SEQ ID NO: 35089 - protein, 251 aa, Artificial Sequence
  Description of Artificial Sequence: Synthetic polypeptide
  XENP024379 1C11_H3_L3.129_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 35090 - protein, 117 aa, Artificial Sequence; identical to SEQ ID NO: 33034
  Description of Artificial Sequence: Synthetic polypeptide
  VH of XENP024379

SEQ ID NO: 35091 - protein, 114 aa, Artificial Sequence
  Description of Artificial Sequence: Synthetic polypeptide
  VL of XENP024379
DVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIKGS

SEQ ID NO: 35092 - protein, 5 aa, Artificial Sequence
  Description of Artificial Sequence: Synthetic peptide
  XENP024379 vhCDR1
HYGMN

SEQ ID NO: 35093 - protein, 17 aa, Artificial Sequence
  Description of Artificial Sequence: Synthetic peptide
  XENP024379 vhCDR2
WINTYTGEPTYADGFTG

SEQ ID NO: 35094 - protein, 8 aa, Artificial Sequence
  Description of Artificial Sequence: Synthetic peptide
  XENP024379 vhCDR3
DYYGSSPY

SEQ ID NO: 35095 - protein, 16 aa, Artificial Sequence
  Description of Artificial Sequence: Synthetic peptide
  XENP024379 vlCDR1
KSSQSIVHSNGNTYLE

SEQ ID NO: 35096 - protein, 7 aa, Artificial Sequence
  Description of Artificial Sequence: Synthetic peptide
  XENP024379 vlCDR2
KVSNRFS

SEQ ID NO: 35097 - protein, 9 aa, Artificial Sequence
  Description of Artificial Sequence: Synthetic peptide
  XENP024379 vlCDR3
HQGSHVPNT

SEQ ID NO: 35098 - protein, 251 aa, Artificial Sequence
  Description of Artificial Sequence: Synthetic polypeptide
  XENP024380 1C11_H3.176_L3.92_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKGS

SEQ ID NO: 35099 - protein, 117 aa, Artificial Sequence
  Description of Artificial Sequence: Synthetic polypeptide
  VH of XENP024380
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSS

SEQ ID NO: 35100 - protein, 114 aa, Artificial Sequence; identical to SEQ ID NO: 35055
  Description of Artificial Sequence: Synthetic polypeptide
  VL of XENP024380

SEQ ID NO: 35101 - protein, 5 aa, Artificial Sequence
  Description of Artificial Sequence: Synthetic peptide
  XENP024380 vhCDR1
HYGMN

SEQ ID NO: 35102 - protein, 17 aa, Artificial Sequence
  Description of Artificial Sequence: Synthetic peptide
  XENP024380 vhCDR2
WINTNTGEPTYADKFTG

SEQ ID NO: 35103 - protein, 8 aa, Artificial Sequence
  Description of Artificial Sequence: Synthetic peptide
  XENP024380 vhCDR3
DYYGSSPY

SEQ ID NO: 35104 - protein, 16 aa, Artificial Sequence
  Description of Artificial Sequence: Synthetic peptide
  XENP024380 vlCDR1
KASQSIVHSNGNTYLE

SEQ ID NO: 35105 - protein, 7 aa, Artificial Sequence
  Description of Artificial Sequence: Synthetic peptide
  XENP024380 vlCDR2
KVSNRFT

SEQ ID NO: 35106 - protein, 9 aa, Artificial Sequence
  Description of Artificial Sequence: Synthetic peptide
  XENP024380 vlCDR3
FQGSHVPNT

SEQ ID NO: 35107 - protein, 251 aa, Artificial Sequence
  Description of Artificial Sequence: Synthetic polypeptide
  XENP024381 1C11_H3.176_L3.94_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIKGS

SEQ ID NO: 35108 - protein, 117 aa, Artificial Sequence; identical to SEQ ID NO: 35099
  Description of Artificial Sequence: Synthetic polypeptide
  VH of XENP024381

SEQ ID NO: 35109 - protein, 114 aa, Artificial Sequence; identical to SEQ ID NO: 35064
  Description of Artificial Sequence: Synthetic polypeptide
  VL of XENP024381

SEQ ID NO: 35110 - protein, 5 aa, Artificial Sequence
  Description of Artificial Sequence: Synthetic peptide
  XENP024381 vhCDR1
HYGMN

SEQ ID NO: 35111 - protein, 17 aa, Artificial Sequence
  Description of Artificial Sequence: Synthetic peptide
  XENP024381 vhCDR2
WINTNTGEPTYADKFTG

SEQ ID NO: 35112 - protein, 8 aa, Artificial Sequence
  Description of Artificial Sequence: Synthetic peptide
  XENP024381 vhCDR3
DYYGSSPY

SEQ ID NO: 35113 - protein, 16 aa, Artificial Sequence
  Description of Artificial Sequence: Synthetic peptide
  XENP024381 vlCDR1
KSSQSIVHSNGNTYLE

SEQ ID NO: 35114 - protein, 7 aa, Artificial Sequence
  Description of Artificial Sequence: Synthetic peptide
  XENP024381 vlCDR2
KVSNRFT

SEQ ID NO: 35115 - protein, 9 aa, Artificial Sequence
  Description of Artificial Sequence: Synthetic peptide
  XENP024381 vlCDR3
FQGSHVPNT

SEQ ID NO: 35116 - protein, 251 aa, Artificial Sequence
  Description of Artificial Sequence: Synthetic polypeptide
  XENP024382 1C11_H3.176_L3.96_scFv
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIKGS

SEQ ID NO: 35117 - protein, 117 aa, Artificial Sequence; identical to SEQ ID NO: 35099
  Description of Artificial Sequence: Synthetic polypeptide
  VH of XENP024382

SEQ ID NO: 35118 - protein, 114 aa, Artificial Sequence; identical to SEQ ID NO: 35073
  Description of Artificial Sequence: Synthetic polypeptide
  VL of XENP024382

SEQ ID NO: 35119 - protein, 5 aa, Artificial Sequence
  Description of Artificial Sequence: Synthetic peptide
  XENP024382 vhCDR1
HYGMN

SEQ ID NO: 35120 - protein, 17 aa, Artificial Sequence
  Description of Artificial Sequence: Synthetic peptide
  XENP024382 vhCDR2
WINTNTGEPTYADKFTG

SEQ ID NO: 35121 - protein, 8 aa, Artificial Sequence
  Description of Artificial Sequence: Synthetic peptide
  XENP024382 vhCDR3
DYYGSSPY

SEQ ID NO: 35122 - protein, 16 aa, Artificial Sequence
  Description of Artificial Sequence: Synthetic peptide
  XENP024382 vlCDR1
KASQSIVHSNGNTYLE

SEQ ID NO: 35123 - protein, 7 aa, Artificial Sequence
  Description of Artificial Sequence: Synthetic peptide
  XENP024382 vlCDR2
KVSNRFT

SEQ ID NO: 35124 - protein, 9 aa, Artificial Sequence
  Description of Artificial Sequence: Synthetic peptide
  XENP024382 vlCDR3
FQGSHVPNT

SEQ ID NO: 35125 - protein, 251 aa, Artificial Sequence
  Description of Artificial Sequence: Synthetic polypeptide
  XENP024414 1C11_H3_L3.133_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35126 - protein, 117 aa, Artificial Sequence; identical to SEQ ID NO: 33034
  Description of Artificial Sequence: Synthetic polypeptide
  VH of XENP024414

SEQ ID NO: 35127 - protein, 114 aa, Artificial Sequence
  Description of Artificial Sequence: Synthetic polypeptide
  VL of XENP024414
DVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35128 - protein, 5 aa, Artificial Sequence
  Description of Artificial Sequence: Synthetic peptide
  XENP024414 vhCDR1
HYGMN

SEQ ID NO: 35129 - protein, 17 aa, Artificial Sequence
  Description of Artificial Sequence: Synthetic peptide
  XENP024414 vhCDR2
WINTYTGEPTYADGFTG

SEQ ID NO: 35130 - protein, 8 aa, Artificial Sequence
  Description of Artificial Sequence: Synthetic peptide
  XENP024414 vhCDR3
DYYGSSPY

SEQ ID NO: 35131 - protein, 16 aa, Artificial Sequence
  Description of Artificial Sequence: Synthetic peptide
  XENP024414 vlCDR1
KASQSIVHSNGNTYLE

SEQ ID NO: 35132 - protein, 7 aa, Artificial Sequence
  Description of Artificial Sequence: Synthetic peptide
  XENP024414 vlCDR2
KVSNRFS

SEQ ID NO: 35133 - protein, 9 aa, Artificial Sequence
  Description of Artificial Sequence: Synthetic peptide
  XENP024414 vlCDR3
FQGSHVPNT

SEQ ID NO: 35134 - protein, 251 aa, Artificial Sequence
  Description of Artificial Sequence: Synthetic polypeptide
  XENP024415 1C11_H3_L3.134_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35135 - protein, 117 aa, Artificial Sequence; identical to SEQ ID NO: 33034
  Description of Artificial Sequence: Synthetic polypeptide
  VH of XENP024415

SEQ ID NO: 35136 - protein, 114 aa, Artificial Sequence
  Description of Artificial Sequence: Synthetic polypeptide
  VL of XENP024415
DVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35137 - protein, 5 aa, Artificial Sequence
  Description of Artificial Sequence: Synthetic peptide
  XENP024415 vhCDR1
HYGMN

SEQ ID NO: 35138 - protein, 17 aa, Artificial Sequence
  Description of Artificial Sequence: Synthetic peptide
  XENP024415 vhCDR2
WINTYTGEPTYADGFTG

SEQ ID NO: 35139 - protein, 8 aa, Artificial Sequence
  Description of Artificial Sequence: Synthetic peptide
  XENP024415 vhCDR3
DYYGSSPY

SEQ ID NO: 35140 - protein, 16 aa, Artificial Sequence
  Description of Artificial Sequence: Synthetic peptide
  XENP024415 vlCDR1
KASQSIVHSNGNTYLE

SEQ ID NO: 35141 - protein, 7 aa, Artificial Sequence
  Description of Artificial Sequence: Synthetic peptide
  XENP024415 vlCDR2
KVSNRFS

SEQ ID NO: 35142 - protein, 9 aa, Artificial Sequence
  Description of Artificial Sequence: Synthetic peptide
  XENP024415 vlCDR3
FQGSHVPNT

SEQ ID NO: 35143 - protein, 251 aa, Artificial Sequence
  Description of Artificial Sequence: Synthetic polypeptide
  XENP024416 1C11_H3_L3.135_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35144 - protein, 117 aa, Artificial Sequence; identical to SEQ ID NO: 33034
  Description of Artificial Sequence: Synthetic polypeptide
  VH of XENP024416

SEQ ID NO: 35145 - protein, 114 aa, Artificial Sequence
  Description of Artificial Sequence: Synthetic polypeptide
  VL of XENP024416
DVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35146 - protein, 5 aa, Artificial Sequence
  Description of Artificial Sequence: Synthetic peptide
  XENP024416 vhCDR1
HYGMN

SEQ ID NO: 35147 - protein, 17 aa, Artificial Sequence
  Description of Artificial Sequence: Synthetic peptide
  XENP024416 vhCDR2
WINTYTGEPTYADGFTG

SEQ ID NO: 35148 - protein, 8 aa, Artificial Sequence
  Description of Artificial Sequence: Synthetic peptide
  XENP024416 vhCDR3
DYYGSSPY

SEQ ID NO: 35149 - protein, 16 aa, Artificial Sequence
  Description of Artificial Sequence: Synthetic peptide
  XENP024416 vlCDR1
KASQSIVHSNGNTYLE

SEQ ID NO: 35150 - protein, 7 aa, Artificial Sequence
  Description of Artificial Sequence: Synthetic peptide
  XENP024416 vlCDR2
KVSNRFS

SEQ ID NO: 35151 - protein, 9 aa, Artificial Sequence
  Description of Artificial Sequence: Synthetic peptide
  XENP024416 vlCDR3
FQGSHVPNT

SEQ ID NO: 35152 - protein, 251 aa, Artificial Sequence
  Description of Artificial Sequence: Synthetic polypeptide
  XENP024417 1C11_H3_L3.136_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35153 - protein, 117 aa, Artificial Sequence; identical to SEQ ID NO: 33034
  Description of Artificial Sequence: Synthetic polypeptide
  VH of XENP024417

SEQ ID NO: 35154 - protein, 114 aa, Artificial Sequence
  Description of Artificial Sequence: Synthetic polypeptide
  VL of XENP024417
DVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIKGS

SEQ ID NO: 35155 - protein, 5 aa, Artificial Sequence
  Description of Artificial Sequence: Synthetic peptide
  XENP024417 vhCDR1
HYGMN

SEQ ID NO: 35156 - protein, 17 aa, Artificial Sequence
  Description of Artificial Sequence: Synthetic peptide
  XENP024417 vhCDR2
WINTYTGEPTYADGFTG

SEQ ID NO: 35157 - protein, 8 aa, Artificial Sequence
  Description of Artificial Sequence: Synthetic peptide
  XENP024417 vhCDR3
DYYGSSPY

SEQ ID NO: 35158 - protein, 16 aa, Artificial Sequence
  Description of Artificial Sequence: Synthetic peptide
  XENP024417 vlCDR1
KASQSIVHSNGNTYLE

SEQ ID NO: 35159 - protein, 7 aa, Artificial Sequence
  Description of Artificial Sequence: Synthetic peptide
  XENP024417 vlCDR2
KVSNRFS

SEQ ID NO: 35160 - protein, 9 aa, Artificial Sequence
  Description of Artificial Sequence: Synthetic peptide
  XENP024417 vlCDR3
FQGSHVPNT

SEQ ID NO: 35161 - protein, 251 aa, Artificial Sequence
  Description of Artificial Sequence: Synthetic polypeptide
  XENP024418 1C11_H3_L3.137_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35162 - protein, 117 aa, Artificial Sequence; identical to SEQ ID NO: 33034
  Description of Artificial Sequence: Synthetic polypeptide
  VH of XENP024418

SEQ ID NO: 35163 - protein, 114 aa, Artificial Sequence
  Description of Artificial Sequence: Synthetic polypeptide
  VL of XENP024418
DVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIKGS

SEQ ID NO: 35164 - protein, 5 aa, Artificial Sequence
  Description of Artificial Sequence: Synthetic peptide
  XENP024418 vhCDR1
HYGMN

SEQ ID NO: 35165 - protein, 17 aa, Artificial Sequence
  Description of Artificial Sequence: Synthetic peptide
  XENP024418 vhCDR2
WINTYTGEPTYADGFTG

SEQ ID NO: 35166 - protein, 8 aa, Artificial Sequence
  Description of Artificial Sequence: Synthetic peptide
  XENP024418 vhCDR3
DYYGSSPY

SEQ ID NO: 35167 - protein, 16 aa, Artificial Sequence
  Description of Artificial Sequence: Synthetic peptide
  XENP024418 vlCDR1
KASQSIVHSNGNTYLE

SEQ ID NO: 35168 - protein, 7 aa, Artificial Sequence
  Description of Artificial Sequence: Synthetic peptide
  XENP024418 vlCDR2
KVSNRFS

SEQ ID NO: 35169 - protein, 9 aa, Artificial Sequence
  Description of Artificial Sequence: Synthetic peptide
  XENP024418 vlCDR3
FQGSHVPNT

SEQ ID NO: 35170 - protein, 251 aa, Artificial Sequence
  Description of Artificial Sequence: Synthetic polypeptide
  XENP024419 1C11_H3_L3.138_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35171 - protein, 117 aa, Artificial Sequence; identical to SEQ ID NO: 33034
  Description of Artificial Sequence: Synthetic polypeptide
  VH of XENP024419

SEQ ID NO: 35172 - protein, 114 aa, Artificial Sequence
  Description of Artificial Sequence: Synthetic polypeptide
  VL of XENP024419
DVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIKGS

SEQ ID NO: 35173 - protein, 5 aa, Artificial Sequence
  Description of Artificial Sequence: Synthetic peptide
  XENP024419 vhCDR1
HYGMN

SEQ ID NO: 35174 - protein, 17 aa, Artificial Sequence
  Description of Artificial Sequence: Synthetic peptide
  XENP024419 vhCDR2
WINTYTGEPTYADGFTG

SEQ ID NO: 35175 - protein, 8 aa, Artificial Sequence
  Description of Artificial Sequence: Synthetic peptide
  XENP024419 vhCDR3
DYYGSSPY

SEQ ID NO: 35176 - protein, 16 aa, Artificial Sequence
  Description of Artificial Sequence: Synthetic peptide
  XENP024419 vlCDR1
KASQSIVHSNGNTYLE

SEQ ID NO: 35177 - protein, 7 aa, Artificial Sequence
  Description of Artificial Sequence: Synthetic peptide
  XENP024419 vlCDR2
KVSNRFS

SEQ ID NO: 35178 - protein, 9 aa, Artificial Sequence
  Description of Artificial Sequence: Synthetic peptide
  XENP024419 vlCDR3
FQGSHVPNT

SEQ ID NO: 35179 - protein, 251 aa, Artificial Sequence
  Description of Artificial Sequence: Synthetic polypeptide
  XENP024420 1C11_H3_L3.139_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 35180 - protein, 117 aa, Artificial Sequence; identical to SEQ ID NO: 33034
  Description of Artificial Sequence: Synthetic polypeptide
  VH of XENP024420

SEQ ID NO: 35181 - protein, 114 aa, Artificial Sequence
  Description of Artificial Sequence: Synthetic polypeptide
  VL of XENP024420
DVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIKGS

SEQ ID NO: 35182 - protein, 5 aa, Artificial Sequence
  Description of Artificial Sequence: Synthetic peptide
  XENP024420 vhCDR1
HYGMN

SEQ ID NO: 35183 - protein, 17 aa, Artificial Sequence
  Description of Artificial Sequence: Synthetic peptide
  XENP024420 vhCDR2
WINTYTGEPTYADGFTG

SEQ ID NO: 35184 - protein, 8 aa, Artificial Sequence
  Description of Artificial Sequence: Synthetic peptide
  XENP024420 vhCDR3
DYYGSSPY

SEQ ID NO: 35185 - protein, 16 aa, Artificial Sequence
  Description of Artificial Sequence: Synthetic peptide
  XENP024420 vlCDR1
KASQSIVHSNGNTYLE

SEQ ID NO: 35186 - protein, 7 aa, Artificial Sequence
  Description of Artificial Sequence: Synthetic peptide
  XENP024420 vlCDR2
KVSNRFS

SEQ ID NO: 35187 - protein, 9 aa, Artificial Sequence
  Description of Artificial Sequence: Synthetic peptide
  XENP024420 vlCDR3
FQGSHVPNT

SEQ ID NO: 35188 - protein, 251 aa, Artificial Sequence
  Description of Artificial Sequence: Synthetic polypeptide
  XENP024421 1C11_H3_L3.140_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 35189 - protein, 117 aa, Artificial Sequence; identical to SEQ ID NO: 33034
  Description of Artificial Sequence: Synthetic polypeptide
  VH of XENP024421

SEQ ID NO: 35190 - protein, 114 aa, Artificial Sequence
  Description of Artificial Sequence: Synthetic polypeptide
  VL of XENP024421
DIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIKGS

SEQ ID NO: 35191 - protein, 5 aa, Artificial Sequence
  Description of Artificial Sequence: Synthetic peptide
  XENP024421 vhCDR1
HYGMN

SEQ ID NO: 35192 - protein, 17 aa, Artificial Sequence
  Description of Artificial Sequence: Synthetic peptide
  XENP024421 vhCDR2
WINTYTGEPTYADGFTG

SEQ ID NO: 35193 - protein, 8 aa, Artificial Sequence
  Description of Artificial Sequence: Synthetic peptide
  XENP024421 vhCDR3
DYYGSSPY

SEQ ID NO: 35194 - protein, 16 aa, Artificial Sequence
  Description of Artificial Sequence: Synthetic peptide
  XENP024421 vlCDR1
KASQSIVHSNGNTYLE

SEQ ID NO: 35195 - protein, 7 aa, Artificial Sequence
  Description of Artificial Sequence: Synthetic peptide
  XENP024421 vlCDR2
KVSNRFS

SEQ ID NO: 35196 - protein, 9 aa, Artificial Sequence
  Description of Artificial Sequence: Synthetic peptide
  XENP024421 vlCDR3
FQGSHVPNT

SEQ ID NO: 35197 - protein, 251 aa, Artificial Sequence
  Description of Artificial Sequence: Synthetic polypeptide
  XENP024422 1C11_H3_L3.141_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 35198 - protein, 117 aa, Artificial Sequence; identical to SEQ ID NO: 33034
  Description of Artificial Sequence: Synthetic polypeptide
  VH of XENP024422

SEQ ID NO: 35199 - protein, 114 aa, Artificial Sequence
  Description of Artificial Sequence: Synthetic polypeptide
  VL of XENP024422
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIKGS

SEQ ID NO: 35200 - protein, 5 aa, Artificial Sequence
  Description of Artificial Sequence: Synthetic peptide
  XENP024422 vhCDR1
HYGMN

SEQ ID NO: 35201 - protein, 17 aa, Artificial Sequence
  Description of Artificial Sequence: Synthetic peptide
  XENP024422 vhCDR2
WINTYTGEPTYADGFTG

SEQ ID NO: 35202 - protein, 8 aa, Artificial Sequence
  Description of Artificial Sequence: Synthetic peptide
  XENP024422 vhCDR3
DYYGSSPY

SEQ ID NO: 35203 - protein, 16 aa, Artificial Sequence
  Description of Artificial Sequence: Synthetic peptide
  XENP024422 vlCDR1
KASQSIVHSNGNTYLE

SEQ ID NO: 35204 - protein, 7 aa, Artificial Sequence
  Description of Artificial Sequence: Synthetic peptide
  XENP024422 vlCDR2
KVSNRFS

SEQ ID NO: 35205 - protein, 9 aa, Artificial Sequence
  Description of Artificial Sequence: Synthetic peptide
  XENP024422 vlCDR3
FQGSHVPNT

SEQ ID NO: 35206 - protein, 251 aa, Artificial Sequence
  Description of Artificial Sequence: Synthetic polypeptide
  XENP024423 1C11_H3_L3.142_scFv
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 35207 - protein, 117 aa, Artificial Sequence; identical to SEQ ID NO: 33034
  Description of Artificial Sequence: Synthetic polypeptide
  VH of XENP024423

SEQ ID NO: 35208 - protein, 114 aa, Artificial Sequence
  Description of Artificial Sequence: Synthetic polypeptide
  VL of XENP024423
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIKGS

SEQ ID NO: 35209 - protein, 5 aa, Artificial Sequence
  Description of Artificial Sequence: Synthetic peptide
  XENP024423 vhCDR1
HYGMN

SEQ ID NO: 35210 - protein, 17 aa, Artificial Sequence
  Description of Artificial Sequence: Synthetic peptide
  XENP024423 vhCDR2
WINTYTGEPTYADGFTG

SEQ ID NO: 35211 - protein, 8 aa, Artificial Sequence
  Description of Artificial Sequence: Synthetic peptide
  XENP024423 vhCDR3
DYYGSSPY

SEQ ID NO: 35212 - protein, 16 aa, Artificial Sequence
  Description of Artificial Sequence: Synthetic peptide
  XENP024423 vlCDR1
KASQSIVHSNGNTYLE

SEQ ID NO: 35213 - protein, 7 aa, Artificial Sequence
  Description of Artificial Sequence: Synthetic peptide
  XENP024423 vlCDR2
KVSNRFS

SEQ ID NO: 35214 - protein, 9 aa, Artificial Sequence
  Description of Artificial Sequence: Synthetic peptide
  XENP024423 vlCDR3
FQGSHVPNT

SEQ ID NO: 35215 - protein, 251 aa, Artificial Sequence
  Description of Artificial Sequence: Synthetic polypeptide
  XENP024424 1C11_H3.176_L3_scFv
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35216 - protein, 117 aa, Artificial Sequence
  Description of Artificial Sequence: Synthetic polypeptide
  VH of XENP024424
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSS

SEQ ID NO: 35217 - protein, 114 aa, Artificial Sequence; identical to SEQ ID NO: 33651
  Description of Artificial Sequence: Synthetic polypeptide
  VL of XENP024424

SEQ ID NO: 35218 - protein, 5 aa, Artificial Sequence
  Description of Artificial Sequence: Synthetic peptide
  XENP024424 vhCDR1
HYGMN

SEQ ID NO: 35219 - protein, 17 aa, Artificial Sequence
  Description of Artificial Sequence: Synthetic peptide
  XENP024424 vhCDR2
WINTYTGEPTYAPGFKG

SEQ ID NO: 35220 - protein, 8 aa, Artificial Sequence
  Description of Artificial Sequence: Synthetic peptide
  XENP024424 vhCDR3
DYYGSSPY

SEQ ID NO: 35221 - protein, 16 aa, Artificial Sequence
  Description of Artificial Sequence: Synthetic peptide
  XENP024424 vlCDR1
KSSQSIVHSNGNTYLE

SEQ ID NO: 35222 - protein, 7 aa, Artificial Sequence
  Description of Artificial Sequence: Synthetic peptide
  XENP024424 vlCDR2
KVSNRFS

SEQ ID NO: 35223 - protein, 9 aa, Artificial Sequence
  Description of Artificial Sequence: Synthetic peptide
  XENP024424 vlCDR3
FQGSHVPNT

SEQ ID NO: 35224 - protein, 251 aa, Artificial Sequence
  Description of Artificial Sequence: Synthetic polypeptide
  XENP024425 1C11_H3.177_L3_scFv
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35225 - protein, 117 aa, Artificial Sequence
  Description of Artificial Sequence: Synthetic polypeptide
  VH of XENP024425
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSS

SEQ ID NO: 35226 - protein, 114 aa, Artificial Sequence; identical to SEQ ID NO: 33651
  Description of Artificial Sequence: Synthetic polypeptide
  VL of XENP024425

SEQ ID NO: 35227 - protein, 5 aa, Artificial Sequence
  Description of Artificial Sequence: Synthetic peptide
  XENP024425 vhCDR1
HYGMN

SEQ ID NO: 35228 - protein, 17 aa, Artificial Sequence
  Description of Artificial Sequence: Synthetic peptide
  XENP024425 vhCDR2
WINTYTGEPTYAPKFTG

SEQ ID NO: 35229 - protein, 8 aa, Artificial Sequence
  Description of Artificial Sequence: Synthetic peptide
  XENP024425 vhCDR3
DYYGSSPY

SEQ ID NO: 35230 - protein, 16 aa, Artificial Sequence
  Description of Artificial Sequence: Synthetic peptide
  XENP024425 vlCDR1
KSSQSIVHSNGNTYLE

SEQ ID NO: 35231 - protein, 7 aa, Artificial Sequence
  Description of Artificial Sequence: Synthetic peptide
  XENP024425 vlCDR2
KVSNRFS

SEQ ID NO: 35232 - protein, 9 aa, Artificial Sequence
  Description of Artificial Sequence: Synthetic peptide
  XENP024425 vlCDR3
FQGSHVPNT

SEQ ID NO: 35233 - protein, 251 aa, Artificial Sequence
  Description of Artificial Sequence: Synthetic polypeptide
  XENP024426 1C11_H3.178_L3_scFv
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35234 - protein, 117 aa, Artificial Sequence
  Description of Artificial Sequence: Synthetic polypeptide
  VH of XENP024426
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSS

SEQ ID NO: 35235 - protein, 114 aa, Artificial Sequence; identical to SEQ ID NO: 33651
  Description of Artificial Sequence: Synthetic polypeptide
  VL of XENP024426

SEQ ID NO: 35236 - protein, 5 aa, Artificial Sequence
  Description of Artificial Sequence: Synthetic peptide
  XENP024426 vhCDR1
HYGMN

SEQ ID NO: 35237 - protein, 17 aa, Artificial Sequence
  Description of Artificial Sequence: Synthetic peptide
  XENP024426 vhCDR2
WINTYTGEPTYAPGFKE

SEQ ID NO: 35238 - protein, 8 aa, Artificial Sequence
  Description of Artificial Sequence: Synthetic peptide
  XENP024426 vhCDR3
DYYGSSPY

SEQ ID NO: 35239 - protein, 16 aa, Artificial Sequence
  Description of Artificial Sequence: Synthetic peptide
  XENP024426 vlCDR1
KSSQSIVHSNGNTYLE

SEQ ID NO: 35240 - protein, 7 aa, Artificial Sequence
  Description of Artificial Sequence: Synthetic peptide
  XENP024426 vlCDR2
KVSNRFS

SEQ ID NO: 35241 - protein, 9 aa, Artificial Sequence
  Description of Artificial Sequence: Synthetic peptide
  XENP024426 vlCDR3
FQGSHVPNT

SEQ ID NO: 35242 - protein, 251 aa, Artificial Sequence
  Description of Artificial Sequence: Synthetic polypeptide
  XENP024427 1C11_H3.179_L3_scFv
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35243 - protein, 117 aa, Artificial Sequence
  Description of Artificial Sequence: Synthetic polypeptide
  VH of XENP024427
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSS

SEQ ID NO: 35244 - protein, 114 aa, Artificial Sequence; identical to SEQ ID NO: 33651
  Description of Artificial Sequence: Synthetic polypeptide
  VL of XENP024427

SEQ ID NO: 35245 - protein, 5 aa, Artificial Sequence
  Description of Artificial Sequence: Synthetic peptide
  XENP024427 vhCDR1
HYGMN

SEQ ID NO: 35246 - protein, 17 aa, Artificial Sequence
  Description of Artificial Sequence: Synthetic peptide
  XENP024427 vhCDR2
WINTYTGEPTYAPKFTE

SEQ ID NO: 35247 - protein, 8 aa, Artificial Sequence
  Description of Artificial Sequence: Synthetic peptide
  XENP024427 vhCDR3
DYYGSSPY

SEQ ID NO: 35248 - protein, 16 aa, Artificial Sequence
  Description of Artificial Sequence: Synthetic peptide
  XENP024427 vlCDR1
KSSQSIVHSNGNTYLE

SEQ ID NO: 35249 - protein, 7 aa, Artificial Sequence
  Description of Artificial Sequence: Synthetic peptide
  XENP024427 vlCDR2
KVSNRFS

SEQ ID NO: 35250 - protein, 9 aa, Artificial Sequence
  Description of Artificial Sequence: Synthetic peptide
  XENP024427 vlCDR3
FQGSHVPNT

SEQ ID NO: 35251 - protein, 251 aa, Artificial Sequence
  Description of Artificial Sequence: Synthetic polypeptide
  XENP024428 1C11_H3.180_L3_scFv
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35252 - protein, 117 aa, Artificial Sequence
  Description of Artificial Sequence: Synthetic polypeptide
  VH of XENP024428
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSS

SEQ ID NO: 35253 - protein, 114 aa, Artificial Sequence; identical to SEQ ID NO: 33651
  Description of Artificial Sequence: Synthetic polypeptide
  VL of XENP024428

SEQ ID NO: 35254 - protein, 5 aa, Artificial Sequence
  Description of Artificial Sequence: Synthetic peptide
  XENP024428 vhCDR1
HYGIN

SEQ ID NO: 35255 - protein, 17 aa, Artificial Sequence
  Description of Artificial Sequence: Synthetic peptide
  XENP024428 vhCDR2
WINTYTGEPTYADGFTG

SEQ ID NO: 35256 - protein, 8 aa, Artificial Sequence
  Description of Artificial Sequence: Synthetic peptide
  XENP024428 vhCDR3
DYYGSSPY

SEQ ID NO: 35257 - protein, 16 aa, Artificial Sequence
  Description of Artificial Sequence: Synthetic peptide
  XENP024428 vlCDR1
KSSQSIVHSNGNTYLE

SEQ ID NO: 35258 - protein, 7 aa, Artificial Sequence
  Description of Artificial Sequence: Synthetic peptide
  XENP024428 vlCDR2
KVSNRFS

SEQ ID NO: 35259 - protein, 9 aa, Artificial Sequence
  Description of Artificial Sequence: Synthetic peptide
  XENP024428 vlCDR3
FQGSHVPNT

SEQ ID NO: 35260 - protein, 251 aa, Artificial Sequence
  Description of Artificial Sequence: Synthetic polypeptide
  XENP024429 1C11_H3.181_L3_scFv
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35261 - protein, 117 aa, Artificial Sequence
  Description of Artificial Sequence: Synthetic polypeptide
  VH of XENP024429
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSS

SEQ ID NO: 35262 - protein, 114 aa, Artificial Sequence; identical to SEQ ID NO: 33651
  Description of Artificial Sequence: Synthetic polypeptide
  VL of XENP024429

SEQ ID NO: 35263 - protein, 5 aa, Artificial Sequence
  Description of Artificial Sequence: Synthetic peptide
  XENP024429 vhCDR1
HYGIN

SEQ ID NO: 35264 - protein, 17 aa, Artificial Sequence
  Description of Artificial Sequence: Synthetic peptide
  XENP024429 vhCDR2
WINTYTGEPTYADGFTG

SEQ ID NO: 35265 - protein, 8 aa, Artificial Sequence
  Description of Artificial Sequence: Synthetic peptide
  XENP024429 vhCDR3
DYYGSSPY

SEQ ID NO: 35266 - protein, 16 aa, Artificial Sequence
  Description of Artificial Sequence: Synthetic peptide
  XENP024429 vlCDR1
KSSQSIVHSNGNTYLE

SEQ ID NO: 35267 - protein, 7 aa, Artificial Sequence
  Description of Artificial Sequence: Synthetic peptide
  XENP024429 vlCDR2
KVSNRFS

SEQ ID NO: 35268 - protein, 9 aa, Artificial Sequence
  Description of Artificial Sequence: Synthetic peptide
  XENP024429 vlCDR3
FQGSHVPNT

SEQ ID NO: 35269 - protein, 251 aa, Artificial Sequence
  Description of Artificial Sequence: Synthetic polypeptide
  XENP024430 1C11_H3.182_L3_scFv
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35270 - protein, 117 aa, Artificial Sequence
  Description of Artificial Sequence: Synthetic polypeptide
  VH of XENP024430
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35271 - protein, 114 aa, Artificial Sequence; identical to SEQ ID NO: 33651
  Description of Artificial Sequence: Synthetic polypeptide
  VL of XENP024430

SEQ ID NO: 35272 - protein, 5 aa, Artificial Sequence
  Description of Artificial Sequence: Synthetic peptide
  XENP024430 vhCDR1
HYGMN

SEQ ID NO: 35273 - protein, 17 aa, Artificial Sequence
  Description of Artificial Sequence: Synthetic peptide
  XENP024430 vhCDR2
WINTYTGEPTYADGFTG

SEQ ID NO: 35274 - protein, 8 aa, Artificial Sequence
  Description of Artificial Sequence: Synthetic peptide
  XENP024430 vhCDR3
DYYGSSPY

SEQ ID NO: 35275 - protein, 16 aa, Artificial Sequence
  Description of Artificial Sequence: Synthetic peptide
  XENP024430 vlCDR1
KSSQSIVHSNGNTYLE

SEQ ID NO: 35276 - protein, 7 aa, Artificial Sequence
  Description of Artificial Sequence: Synthetic peptide
  XENP024430 vlCDR2
KVSNRFS

SEQ ID NO: 35277 - protein, 9 aa, Artificial Sequence
  Description of Artificial Sequence: Synthetic peptide
  XENP024430 vlCDR3
FQGSHVPNT

SEQ ID NO: 35278 - protein, 251 aa, Artificial Sequence
  Description of Artificial Sequence: Synthetic polypeptide
  XENP024431 1C11_H3.183_L3_scFv
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35279 - protein, 117 aa, Artificial Sequence
  Description of Artificial Sequence: Synthetic polypeptide
  VH of XENP024431
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35280 - protein, 114 aa, Artificial Sequence; identical to SEQ ID NO: 33651
  Description of Artificial Sequence: Synthetic polypeptide
  VL of XENP024431

SEQ ID NO: 35281 - protein, 5 aa, Artificial Sequence
  Description of Artificial Sequence: Synthetic peptide
  XENP024431 vhCDR1
HYGMN

SEQ ID NO: 35282 - protein, 17 aa, Artificial Sequence
  Description of Artificial Sequence: Synthetic peptide
  XENP024431 vhCDR2
WINTYTGEPTYADGFTG

SEQ ID NO: 35283 - protein, 8 aa, Artificial Sequence
  Description of Artificial Sequence: Synthetic peptide
  XENP024431 vhCDR3
DYYGSSPY

SEQ ID NO: 35284 - protein, 16 aa, Artificial Sequence
  Description of Artificial Sequence: Synthetic peptide
  XENP024431 vlCDR1
KSSQSIVHSNGNTYLE

SEQ ID NO: 35285 - protein, 7 aa, Artificial Sequence
  Description of Artificial Sequence: Synthetic peptide
  XENP024431 vlCDR2
KVSNRFS

SEQ ID NO: 35286 - protein, 9 aa, Artificial Sequence
  Description of Artificial Sequence: Synthetic peptide
  XENP024431 vlCDR3
FQGSHVPNT

SEQ ID NO: 35287 - protein, 251 aa, Artificial Sequence
  Description of Artificial Sequence: Synthetic polypeptide
  XENP024432 1C11_H3.184_L3_scFv
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35288 - protein, 117 aa, Artificial Sequence
  Description of Artificial Sequence: Synthetic polypeptide
  VH of XENP024432
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 35289 - protein, 114 aa, Artificial Sequence; identical to SEQ ID NO: 33651
  Description of Artificial Sequence: Synthetic polypeptide
  VL of XENP024432

SEQ ID NO: 35290 - protein, 5 aa, Artificial Sequence
  Description of Artificial Sequence: Synthetic peptide
  XENP024432 vhCDR1
HYGMN

SEQ ID NO: 35291 - protein, 17 aa, Artificial Sequence
  Description of Artificial Sequence: Synthetic peptide
  XENP024432 vhCDR2
WINTYTGEPTYADGFTG

SEQ ID NO: 35292 - protein, 8 aa, Artificial Sequence
  Description of Artificial Sequence: Synthetic peptide
  XENP024432 vhCDR3
DYYGSSPY

SEQ ID NO: 35293 - protein, 16 aa, Artificial Sequence
  Description of Artificial Sequence: Synthetic peptide
  XENP024432 vlCDR1
KSSQSIVHSNGNTYLE

SEQ ID NO: 35294 - protein, 7 aa, Artificial Sequence
  Description of Artificial Sequence: Synthetic peptide
  XENP024432 vlCDR2
KVSNRFS

SEQ ID NO: 35295 - protein, 9 aa, Artificial Sequence
  Description of Artificial Sequence: Synthetic peptide
  XENP024432 vlCDR3
FQGSHVPNT

SEQ ID NO: 35296 - protein, 251 aa, Artificial Sequence
  Description of Artificial Sequence: Synthetic polypeptide
  XENP024433 1C11_H3.185_L3_scFv
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35297 - protein, 117 aa, Artificial Sequence
  Description of Artificial Sequence: Synthetic polypeptide
  VH of XENP024433
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSS

SEQ ID NO: 35298 - protein, 114 aa, Artificial Sequence; identical to SEQ ID NO: 33651
  Description of Artificial Sequence: Synthetic polypeptide
  VL of XENP024433

SEQ ID NO: 35299 - protein, 5 aa, Artificial Sequence
  Description of Artificial Sequence: Synthetic peptide
  XENP024433 vhCDR1
HYGIN

SEQ ID NO: 35300 - protein, 17 aa, Artificial Sequence
  Description of Artificial Sequence: Synthetic peptide
  XENP024433 vhCDR2
WINTYTGEPYYAPKFTE

SEQ ID NO: 35301 - protein, 8 aa, Artificial Sequence
  Description of Artificial Sequence: Synthetic peptide
  XENP024433 vhCDR3
DYYGSSPY

SEQ ID NO: 35302 - protein, 16 aa, Artificial Sequence
  Description of Artificial Sequence: Synthetic peptide
  XENP024433 vlCDR1
KSSQSIVHSNGNTYLE

SEQ ID NO: 35303 - protein, 7 aa, Artificial Sequence
  Description of Artificial Sequence: Synthetic peptide
  XENP024433 vlCDR2
KVSNRFS

SEQ ID NO: 35304 - protein, 9 aa, Artificial Sequence
  Description of Artificial Sequence: Synthetic peptide
  XENP024433 vlCDR3
FQGSHVPNT

SEQ ID NO: 35305 - protein, 251 aa, Artificial Sequence
  Description of Artificial Sequence: Synthetic polypeptide
  XENP024434 1C11_H3.186_L3_scFv
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35306 - protein, 117 aa, Artificial Sequence
  Description of Artificial Sequence: Synthetic polypeptide
  VH of XENP024434
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSS

SEQ ID NO: 35307 - protein, 114 aa, Artificial Sequence; identical to SEQ ID NO: 33651
  Description of Artificial Sequence: Synthetic polypeptide
  VL of XENP024434

SEQ ID NO: 35308 - protein, 5 aa, Artificial Sequence
  Description of Artificial Sequence: Synthetic peptide
  XENP024434 vhCDR1
HYGIN

SEQ ID NO: 35309 - protein, 17 aa, Artificial Sequence
  Description of Artificial Sequence: Synthetic peptide
  XENP024434 vhCDR2
WINTYTGEPYYAPGFTE

SEQ ID NO: 35310 - protein, 8 aa, Artificial Sequence
  Description of Artificial Sequence: Synthetic peptide
  XENP024434 vhCDR3
DYYGSSPY

SEQ ID NO: 35311 - protein, 16 aa, Artificial Sequence
  Description of Artificial Sequence: Synthetic peptide
  XENP024434 vlCDR1
KSSQSIVHSNGNTYLE

SEQ ID NO: 35312 - protein, 7 aa, Artificial Sequence
  Description of Artificial Sequence: Synthetic peptide
  XENP024434 vlCDR2
KVSNRFS

SEQ ID NO: 35313 - protein, 9 aa, Artificial Sequence
  Description of Artificial Sequence: Synthetic peptide
  XENP024434 vlCDR3
FQGSHVPNT

SEQ ID NO: 35314 - protein, 251 aa, Artificial Sequence
  Description of Artificial Sequence: Synthetic polypeptide
  XENP024435 1C11_H3.187_L3_scFv
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35315 - protein, 117 aa, Artificial Sequence
  Description of Artificial Sequence: Synthetic polypeptide
  VH of XENP024435
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSS

SEQ ID NO: 35316 - protein, 114 aa, Artificial Sequence; identical to SEQ ID NO: 33651
  Description of Artificial Sequence: Synthetic polypeptide
  VL of XENP024435

SEQ ID NO: 35317 - protein, 5 aa, Artificial Sequence
  Description of Artificial Sequence: Synthetic peptide
  XENP024435 vhCDR1
HYGIN

SEQ ID NO: 35318 - protein, 17 aa, Artificial Sequence
  Description of Artificial Sequence: Synthetic peptide
  XENP024435 vhCDR2
WINTYTGEPYYAPGFTE

SEQ ID NO: 35319 - protein, 8 aa, Artificial Sequence
  Description of Artificial Sequence: Synthetic peptide
  XENP024435 vhCDR3
DYYGSSPY

SEQ ID NO: 35320 - protein, 16 aa, Artificial Sequence
  Description of Artificial Sequence: Synthetic peptide
  XENP024435 vlCDR1
KSSQSIVHSNGNTYLE

SEQ ID NO: 35321 - protein, 7 aa, Artificial Sequence
  Description of Artificial Sequence: Synthetic peptide
  XENP024435 vlCDR2
KVSNRFS

SEQ ID NO: 35322 - protein, 9 aa, Artificial Sequence
  Description of Artificial Sequence: Synthetic peptide
  XENP024435 vlCDR3
FQGSHVPNT

SEQ ID NO: 35323 - protein, 251 aa, Artificial Sequence
  Description of Artificial Sequence: Synthetic polypeptide
  XENP024436 1C11_H3.188_L3_scFv
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35324 - protein, 117 aa, Artificial Sequence
  Description of Artificial Sequence: Synthetic polypeptide
  VH of XENP024436
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 35325 - protein, 114 aa, Artificial Sequence; identical to SEQ ID NO: 33651
  Description of Artificial Sequence: Synthetic polypeptide
  VL of XENP024436

SEQ ID NO: 35326 - protein, 5 aa, Artificial Sequence
  Description of Artificial Sequence: Synthetic peptide
  XENP024436 vhCDR1
HYGIN

SEQ ID NO: 35327 - protein, 17 aa, Artificial Sequence
  Description of Artificial Sequence: Synthetic peptide
  XENP024436 vhCDR2
WINTYTGEPYYAPGFTG

SEQ ID NO: 35328 - protein, 8 aa, Artificial Sequence
  Description of Artificial Sequence: Synthetic peptide
  XENP024436 vhCDR3
DYYGSSPY

SEQ ID NO: 35329 - protein, 16 aa, Artificial Sequence
  Description of Artificial Sequence: Synthetic peptide
  XENP024436 vlCDR1
KSSQSIVHSNGNTYLE

SEQ ID NO: 35330 - protein, 7 aa, Artificial Sequence
  Description of Artificial Sequence: Synthetic peptide
  XENP024436 vlCDR2
KVSNRFS

SEQ ID NO: 35331 - protein, 9 aa, Artificial Sequence
  Description of Artificial Sequence: Synthetic peptide
  XENP024436 vlCDR3
FQGSHVPNT

SEQ ID NO: 35332 - protein, 251 aa, Artificial Sequence
  Description of Artificial Sequence: Synthetic polypeptide
  XENP024437 1C11_H3.189_L3_scFv
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35333 - protein, 117 aa, Artificial Sequence
  Description of Artificial Sequence: Synthetic polypeptide
  VH of XENP024437
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSS

SEQ ID NO: 35334 - protein, 114 aa, Artificial Sequence; identical to SEQ ID NO: 33651
  Description of Artificial Sequence: Synthetic polypeptide
  VL of XENP024437

SEQ ID NO: 35335 - protein, 5 aa, Artificial Sequence
  Description of Artificial Sequence: Synthetic peptide
  XENP024437 vhCDR1
HYGIN

SEQ ID NO: 35336 - protein, 17 aa, Artificial Sequence
  Description of Artificial Sequence: Synthetic peptide
  XENP024437 vhCDR2
WINTYTGEPYYAPKFTG

SEQ ID NO: 35337 - protein, 8 aa, Artificial Sequence
  Description of Artificial Sequence: Synthetic peptide
  XENP024437 vhCDR3
DYYGSSPY

SEQ ID NO: 35338 - protein, 16 aa, Artificial Sequence
  Description of Artificial Sequence: Synthetic peptide
  XENP024437 vlCDR1
KSSQSIVHSNGNTYLE

SEQ ID NO: 35339 - protein, 7 aa, Artificial Sequence
  Description of Artificial Sequence: Synthetic peptide
  XENP024437 vlCDR2
KVSNRFS

SEQ ID NO: 35340 - protein, 9 aa, Artificial Sequence
  Description of Artificial Sequence: Synthetic peptide
  XENP024437 vlCDR3
FQGSHVPNT

SEQ ID NO: 35341 - protein, 251 aa, Artificial Sequence
  Description of Artificial Sequence: Synthetic polypeptide
  XENP024438 1C11_H3.190_L3_scFv
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35342 - protein, 117 aa, Artificial Sequence
  Description of Artificial Sequence: Synthetic polypeptide
  VH of XENP024438
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSS

SEQ ID NO: 35343 - protein, 114 aa, Artificial Sequence; identical to SEQ ID NO: 33651
  Description of Artificial Sequence: Synthetic polypeptide
  VL of XENP024438

SEQ ID NO: 35344 - protein, 5 aa, Artificial Sequence
  Description of Artificial Sequence: Synthetic peptide
  XENP024438 vhCDR1
HYGIN

SEQ ID NO: 35345 - protein, 17 aa, Artificial Sequence
  Description of Artificial Sequence: Synthetic peptide
  XENP024438 vhCDR2
WINTYTGEPYYAPGFTG

SEQ ID NO: 35346 - protein, 8 aa, Artificial Sequence
  Description of Artificial Sequence: Synthetic peptide
  XENP024438 vhCDR3
DYYGSSPY

SEQ ID NO: 35347 - protein, 16 aa, Artificial Sequence
  Description of Artificial Sequence: Synthetic peptide
  XENP024438 vlCDR1
KSSQSIVHSNGNTYLE

SEQ ID NO: 35348 - protein, 7 aa, Artificial Sequence
  Description of Artificial Sequence: Synthetic peptide
  XENP024438 vlCDR2
KVSNRFS

SEQ ID NO: 35349 - protein, 9 aa, Artificial Sequence
  Description of Artificial Sequence: Synthetic peptide
  XENP024438 vlCDR3
FQGSHVPNT

SEQ ID NO: 35350 - protein, 251 aa, Artificial Sequence
  Description of Artificial Sequence: Synthetic polypeptide
  XENP024439 1C11_H3.191_L3_scFv
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35351 - protein, 117 aa, Artificial Sequence
  Description of Artificial Sequence: Synthetic polypeptide
  VH of XENP024439
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSS

SEQ ID NO: 35352 - protein, 114 aa, Artificial Sequence; identical to SEQ ID NO: 33651
  Description of Artificial Sequence: Synthetic polypeptide
  VL of XENP024439

SEQ ID NO: 35353 - protein, 5 aa, Artificial Sequence
  Description of Artificial Sequence: Synthetic peptide
  XENP024439 vhCDR1
HYGMN

SEQ ID NO: 35354 - protein, 17 aa, Artificial Sequence
  Description of Artificial Sequence: Synthetic peptide
  XENP024439 vhCDR2
WINTYTGEPTYAPGFTG

SEQ ID NO: 35355 - protein, 8 aa, Artificial Sequence
  Description of Artificial Sequence: Synthetic peptide
  XENP024439 vhCDR3
DYYGSSPY

SEQ ID NO: 35356 - protein, 16 aa, Artificial Sequence
  Description of Artificial Sequence: Synthetic peptide
  XENP024439 vlCDR1
KSSQSIVHSNGNTYLE

SEQ ID NO: 35357 - protein, 7 aa, Artificial Sequence
  Description of Artificial Sequence: Synthetic peptide
  XENP024439 vlCDR2
KVSNRFS

SEQ ID NO: 35358 - protein, 9 aa, Artificial Sequence
  Description of Artificial Sequence: Synthetic peptide
  XENP024439 vlCDR3
FQGSHVPNT

SEQ ID NO: 35359 - protein, 251 aa, Artificial Sequence
  Description of Artificial Sequence: Synthetic polypeptide
  XENP024440 1C11_H3.192_L3_scFv
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35360 - protein, 117 aa, Artificial Sequence
  Description of Artificial Sequence: Synthetic polypeptide
  VH of XENP024440
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSS

SEQ ID NO: 35361 - protein, 114 aa, Artificial Sequence; identical to SEQ ID NO: 33651
  Description of Artificial Sequence: Synthetic polypeptide
  VL of XENP024440

SEQ ID NO: 35362 - protein, 5 aa, Artificial Sequence
  Description of Artificial Sequence: Synthetic peptide
  XENP024440 vhCDR1
HYGIN

SEQ ID NO: 35363 - protein, 17 aa, Artificial Sequence
  Description of Artificial Sequence: Synthetic peptide
  XENP024440 vhCDR2
WINTYTGEPTYADGFTE

SEQ ID NO: 35364 - protein, 8 aa, Artificial Sequence
  Description of Artificial Sequence: Synthetic peptide
  XENP024440 vhCDR3
DYYGSSPY

SEQ ID NO: 35365 - protein, 16 aa, Artificial Sequence
  Description of Artificial Sequence: Synthetic peptide
  XENP024440 vlCDR1
KSSQSIVHSNGNTYLE

SEQ ID NO: 35366 - protein, 7 aa, Artificial Sequence
  Description of Artificial Sequence: Synthetic peptide
  XENP024440 vlCDR2
KVSNRFS

SEQ ID NO: 35367 - protein, 9 aa, Artificial Sequence
  Description of Artificial Sequence: Synthetic peptide
  XENP024440 vlCDR3
FQGSHVPNT

SEQ ID NO: 35368 - protein, 251 aa, Artificial Sequence
  Description of Artificial Sequence: Synthetic polypeptide
  XENP024441 1C11_H3.193_L3_scFv
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35369 - protein, 117 aa, Artificial Sequence
  Description of Artificial Sequence: Synthetic polypeptide
  VH of XENP024441
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSS

SEQ ID NO: 35370 - protein, 114 aa, Artificial Sequence; identical to SEQ ID NO: 33651
  Description of Artificial Sequence: Synthetic polypeptide
  VL of XENP024441

SEQ ID NO: 35371 - protein, 5 aa, Artificial Sequence
  Description of Artificial Sequence: Synthetic peptide
  XENP024441 vhCDR1
HYGMN

SEQ ID NO: 35372 - protein, 17 aa, Artificial Sequence
  Description of Artificial Sequence: Synthetic peptide
  XENP024441 vhCDR2
WINTYTGEPTYAPGFTE

SEQ ID NO: 35373 - protein, 8 aa, Artificial Sequence
  Description of Artificial Sequence: Synthetic peptide
  XENP024441 vhCDR3
DYYGSSPY

SEQ ID NO: 35374 - protein, 16 aa, Artificial Sequence
  Description of Artificial Sequence: Synthetic peptide
  XENP024441 vlCDR1
KSSQSIVHSNGNTYLE

SEQ ID NO: 35375 - protein, 7 aa, Artificial Sequence
  Description of Artificial Sequence: Synthetic peptide
  XENP024441 vlCDR2
KVSNRFS

SEQ ID NO: 35376 - protein, 9 aa, Artificial Sequence
  Description of Artificial Sequence: Synthetic peptide
  XENP024441 vlCDR3
FQGSHVPNT

SEQ ID NO: 35377 - protein, 251 aa, Artificial Sequence
  Description of Artificial Sequence: Synthetic polypeptide
  XENP024442 1C11_H3.194_L3_scFv
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35378 - protein, 117 aa, Artificial Sequence
  Description of Artificial Sequence: Synthetic polypeptide
  VH of XENP024442
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSS

SEQ ID NO: 35379 - protein, 114 aa, Artificial Sequence; identical to SEQ ID NO: 33651
  Description of Artificial Sequence: Synthetic polypeptide
  VL of XENP024442

SEQ ID NO: 35380 - protein, 5 aa, Artificial Sequence
  Description of Artificial Sequence: Synthetic peptide
  XENP024442 vhCDR1
HYGIN

SEQ ID NO: 35381 - protein, 17 aa, Artificial Sequence
  Description of Artificial Sequence: Synthetic peptide
  XENP024442 vhCDR2
WINTYTGEPTYADGFTG

SEQ ID NO: 35382 - protein, 8 aa, Artificial Sequence
  Description of Artificial Sequence: Synthetic peptide
  XENP024442 vhCDR3
DYYGSSPY

SEQ ID NO: 35383 - protein, 16 aa, Artificial Sequence
  Description of Artificial Sequence: Synthetic peptide
  XENP024442 vlCDR1
KSSQSIVHSNGNTYLE

SEQ ID NO: 35384 - protein, 7 aa, Artificial Sequence
  Description of Artificial Sequence: Synthetic peptide
  XENP024442 vlCDR2
KVSNRFS

SEQ ID NO: 35385 - protein, 9 aa, Artificial Sequence
  Description of Artificial Sequence: Synthetic peptide
  XENP024442 vlCDR3
FQGSHVPNT

SEQ ID NO: 35386 - protein, 251 aa, Artificial Sequence
  Description of Artificial Sequence: Synthetic polypeptide
  XENP024443 1C11_H3.195_L3_scFv
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKGS

SEQ ID NO: 35387 - protein, 117 aa, Artificial Sequence
  Description of Artificial Sequence: Synthetic polypeptide
  VH of XENP024443
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSS

SEQ ID NO: 35388 - protein, 114 aa, Artificial Sequence; identical to SEQ ID NO: 33651
  Description of Artificial Sequence: Synthetic polypeptide
  VL of XENP024443

SEQ ID NO: 35389 - protein, 5 aa, Artificial Sequence
  Description of Artificial Sequence: Synthetic peptide
  XENP024443 vhCDR1
HYGMN

SEQ ID NO: 35390 - protein, 17 aa, Artificial Sequence
  Description of Artificial Sequence: Synthetic peptide
  XENP024443 vhCDR2
WINTYTGEPYYADGFTG

SEQ ID NO: 35391 - protein, 8 aa, Artificial Sequence
  Description of Artificial Sequence: Synthetic peptide
  XENP024443 vhCDR3
DYYGSSPY

SEQ ID NO: 35392 - protein, 16 aa, Artificial Sequence
  Description of Artificial Sequence: Synthetic peptide
  XENP024443 vlCDR1
KSSQSIVHSNGNTYLE

SEQ ID NO: 35393 - protein, 7 aa, Artificial Sequence
  Description of Artificial Sequence: Synthetic peptide
  XENP024443 vlCDR2
KVSNRFS

SEQ ID NO: 35394 - protein, 9 aa, Artificial Sequence
  Description of Artificial Sequence: Synthetic peptide
  XENP024443 vlCDR3
FQGSHVPNT

SEQ ID NO: 35395 - protein, 231 aa, Artificial Sequence
  Description of Artificial Sequence: Synthetic polypeptide
  XENP022835 empty-[CTLA-4]_H3.23_L0.129_scFv Empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35396 - protein, 477 aa, Artificial Sequence; identical to SEQ ID NO: 21669
  Description of Artificial Sequence: Synthetic polypeptide
  XENP022835 empty-[CTLA-4]_H3.23_L0.129_scFv scFv-Fc Heavy Chain

SEQ ID NO: 35397 - protein, 118 aa, Artificial Sequence; identical to SEQ ID NO: 2632
  Description of Artificial Sequence: Synthetic polypeptide
  VH of XENP022835

SEQ ID NO: 35398 - protein, 108 aa, Artificial Sequence; identical to SEQ ID NO: 2768
  Description of Artificial Sequence: Synthetic polypeptide
  VL of XENP022835

SEQ ID NO: 35399 - protein, 231 aa, Artificial Sequence; identical to SEQ ID NO: 21532
  Description of Artificial Sequence: Synthetic polypeptide
  Fc chain of XENP022835

SEQ ID NO: 35400 - protein, 5 aa, Artificial Sequence
  Description of Artificial Sequence: Synthetic peptide
  XENP022835 vhCDR1
SYTMH

SEQ ID NO: 35401 - protein, 17 aa, Artificial Sequence
  Description of Artificial Sequence: Synthetic peptide
  XENP022835 vhCDR2
FISYDGNYKYYADSVKG

SEQ ID NO: 35402 - protein, 9 aa, Artificial Sequence
  Description of Artificial Sequence: Synthetic peptide
  XENP022835 vhCDR3
GGHLGPFDL

SEQ ID NO: 35403 - protein, 12 aa, Artificial Sequence
  Description of Artificial Sequence: Synthetic peptide
  XENP022835 vlCDR1
RASQSVGSSYLA

SEQ ID NO: 35404 - protein, 7 aa, Artificial Sequence
  Description of Artificial Sequence: Synthetic peptide
  XENP022835 vlCDR2
GASSRAT

SEQ ID NO: 35405 - protein, 9 aa, Artificial Sequence
  Description of Artificial Sequence: Synthetic peptide
  XENP022835 vlCDR3
QQYGSSPWT

SEQ ID NO: 35406 - protein, 447 aa, Artificial Sequence; identical to SEQ ID NO: 23556
  Description of Artificial Sequence: Synthetic polypeptide
  XENP023552 [CTLA-4]_H3_L0.22_Fab-empty_Fc(216)_IgG1 Fab-Fc Heavy Chain

SEQ ID NO: 35407 - protein, 118 aa, Artificial Sequence; identical to SEQ ID NO: 139
  Description of Artificial Sequence: Synthetic polypeptide
  VH of XENP023552

SEQ ID NO: 35408 - protein, 5 aa, Artificial Sequence
  Description of Artificial Sequence: Synthetic peptide
  XENP023552 vhCDR1
SYTMH

SEQ ID NO: 35409 - protein, 17 aa, Artificial Sequence
  Description of Artificial Sequence: Synthetic peptide
  XENP023552 vhCDR2
FISYDGNNKYYADSVKG

SEQ ID NO: 35410 - protein, 9 aa, Artificial Sequence
  Description of Artificial Sequence: Synthetic peptide
  XENP023552 vhCDR3
TGWLGPFDY

SEQ ID NO: 35411 - protein, 231 aa, Artificial Sequence; identical to SEQ ID NO: 21572
  Description of Artificial Sequence: Synthetic polypeptide
  XENP023552 [CTLA-4]_H3_L0.22_Fab-empty_Fc(216)_IgG1 Empty-Fc Heavy Chain

SEQ ID NO: 35412 - protein, 215 aa, Artificial Sequence; identical to SEQ ID NO: 4504
  Description of Artificial Sequence: Synthetic polypeptide
  XENP023552 [CTLA-4]_H3_L0.22_Fab-empty_Fc(216)_IgG1 Light Chain

SEQ ID NO: 35413 - protein, 108 aa, Artificial Sequence; identical to SEQ ID NO: 1607
  Description of Artificial Sequence: Synthetic polypeptide
  VL of XENP023552

SEQ ID NO: 35414 - protein, 12 aa, Artificial Sequence
  Description of Artificial Sequence: Synthetic peptide
  XENP023552 vlCDR1
RASQSVSSSYLA

SEQ ID NO: 35415 - protein, 7 aa, Artificial Sequence
  Description of Artificial Sequence: Synthetic peptide
  XENP023552 vlCDR2
GAFSRAT

SEQ ID NO: 35416 - protein, 9 aa, Artificial Sequence
  Description of Artificial Sequence: Synthetic peptide
  XENP023552 vlCDR3
QQYGSSPWT

SEQ ID NO: 35417 - protein, 226 aa, Artificial Sequence
  Description of Artificial Sequence: Synthetic polypeptide
  XENP023041 7G8_H3.66_L1.34_Fab Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35418 - protein, 121 aa, Artificial Sequence
  Description of Artificial Sequence: Synthetic polypeptide
  VH of XENP023041
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35419 - protein, 5 aa, Artificial Sequence
  Description of Artificial Sequence: Synthetic peptide
  XENP023041 vhCDR1
EAWMS

SEQ ID NO: 35420 - protein, 19 aa, Artificial Sequence
  Description of Artificial Sequence: Synthetic peptide
  XENP023041 vhCDR2
EISTKANNHATYYAESVKG

SEQ ID NO: 35421 - protein, 10 aa, Artificial Sequence
  Description of Artificial Sequence: Synthetic peptide
  XENP023041 vhCDR3
LATWDWYFDV

SEQ ID NO: 35422 - protein, 218 aa, Artificial Sequence; identical to SEQ ID NO: 22599
  Description of Artificial Sequence: Synthetic polypeptide
  XENP023041 7G8_H3.66_L1.34_Fab Light Chain

SEQ ID NO: 35423 - protein, 111 aa, Artificial Sequence; identical to SEQ ID NO: 22600
  Description of Artificial Sequence: Synthetic polypeptide
  VL of XENP023041

SEQ ID NO: 35424 - protein, 15 aa, Artificial Sequence
  Description of Artificial Sequence: Synthetic peptide
  XENP023041 vlCDR1
RASQSVDYDGDSYMN

SEQ ID NO: 35425 - protein, 7 aa, Artificial Sequence
  Description of Artificial Sequence: Synthetic peptide
  XENP023041 vlCDR2
AASELES

SEQ ID NO: 35426 - protein, 9 aa, Artificial Sequence
  Description of Artificial Sequence: Synthetic peptide
  XENP023041 vlCDR3
QQSNEDPFT

SEQ ID NO: 35427 - protein, 226 aa, Artificial Sequence
  Description of Artificial Sequence: Synthetic polypeptide
  XENP023042 7G8_H3.67_L1.34_Fab Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35428 - protein, 121 aa, Artificial Sequence
  Description of Artificial Sequence: Synthetic polypeptide
  VH of XENP023042
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35429 - protein, 5 aa, Artificial Sequence
  Description of Artificial Sequence: Synthetic peptide
  XENP023042 vhCDR1
DTWMS

SEQ ID NO: 35430 - protein, 19 aa, Artificial Sequence
  Description of Artificial Sequence: Synthetic peptide
  XENP023042 vhCDR2
EISTKANNHATYYAESVKG

SEQ ID NO: 35431 - protein, 10 aa, Artificial Sequence
  Description of Artificial Sequence: Synthetic peptide
  XENP023042 vhCDR3
LATWDWYFDV

SEQ ID NO: 35432 - protein, 218 aa, Artificial Sequence; identical to SEQ ID NO: 22599
  Description of Artificial Sequence: Synthetic polypeptide
  XENP023042 7G8_H3.67_L1.34_Fab Light Chain

SEQ ID NO: 35433 - protein, 111 aa, Artificial Sequence; identical to SEQ ID NO: 22600
  Description of Artificial Sequence: Synthetic polypeptide
  VL of XENP023042

SEQ ID NO: 35434 - protein, 15 aa, Artificial Sequence
  Description of Artificial Sequence: Synthetic peptide
  XENP023042 vlCDR1
RASQSVDYDGDSYMN

SEQ ID NO: 35435 - protein, 7 aa, Artificial Sequence
  Description of Artificial Sequence: Synthetic peptide
  XENP023042 vlCDR2
AASELES

SEQ ID NO: 35436 - protein, 9 aa, Artificial Sequence
  Description of Artificial Sequence: Synthetic peptide
  XENP023042 vlCDR3
QQSNEDPFT

SEQ ID NO: 35437 - protein, 226 aa, Artificial Sequence
  Description of Artificial Sequence: Synthetic polypeptide
  XENP023043 7G8_H3.68_L1.34_Fab Heavy Chain
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35438 - protein, 121 aa, Artificial Sequence
  Description of Artificial Sequence: Synthetic polypeptide
  VH of XENP023043
EVQLVESGGGLVQPGGSLRLSCAASGFTFDDKWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35439 - protein, 5 aa, Artificial Sequence
  Description of Artificial Sequence: Synthetic peptide
  XENP023043 vhCDR1
DKWMS

SEQ ID NO: 35440 - protein, 19 aa, Artificial Sequence
  Description of Artificial Sequence: Synthetic peptide
  XENP023043 vhCDR2
EISTKANNHATYYAESVKG

SEQ ID NO: 35441 - protein, 10 aa, Artificial Sequence
  Description of Artificial Sequence: Synthetic peptide
  XENP023043 vhCDR3
LATWDWYFDV

SEQ ID NO: 35442 - protein, 218 aa, Artificial Sequence; identical to SEQ ID NO: 22599
  Description of Artificial Sequence: Synthetic polypeptide
  XENP023043 7G8_H3.68_L1.34_Fab Light Chain

SEQ ID NO: 35443 - protein, 111 aa, Artificial Sequence; identical to SEQ ID NO: 22600
  Description of Artificial Sequence: Synthetic polypeptide
  VL of XENP023043

SEQ ID NO: 35444 - protein, 15 aa, Artificial Sequence
  Description of Artificial Sequence: Synthetic peptide
  XENP023043 vlCDR1
RASQSVDYDGDSYMN

SEQ ID NO: 35445 - protein, 7 aa, Artificial Sequence
  Description of Artificial Sequence: Synthetic peptide
  XENP023043 vlCDR2
AASELES

SEQ ID NO: 35446 - protein, 9 aa, Artificial Sequence
  Description of Artificial Sequence: Synthetic peptide
  XENP023043 vlCDR3
QQSNEDPFT

SEQ ID NO: 35447 - protein, 226 aa, Artificial Sequence
  Description of Artificial Sequence: Synthetic polypeptide
  XENP023044 7G8_H3.69_L1.34_Fab Heavy Chain
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35448 - protein, 121 aa, Artificial Sequence
  Description of Artificial Sequence: Synthetic polypeptide
  VH of XENP023044
EVQLVESGGGLVQPGGSLRLSCAASGFTFDDAFMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35449 - protein, 5 aa, Artificial Sequence
  Description of Artificial Sequence: Synthetic peptide
  XENP023044 vhCDR1
DAFMS

SEQ ID NO: 35450 - protein, 19 aa, Artificial Sequence
  Description of Artificial Sequence: Synthetic peptide
  XENP023044 vhCDR2
EISTKANNHATYYAESVKG

SEQ ID NO: 35451 - protein, 10 aa, Artificial Sequence
  Description of Artificial Sequence: Synthetic peptide
  XENP023044 vhCDR3
LATWDWYFDV

SEQ ID NO: 35452 - protein, 218 aa, Artificial Sequence; identical to SEQ ID NO: 22599
  Description of Artificial Sequence: Synthetic polypeptide
  XENP023044 7G8_H3.69_L1.34_Fab Light Chain

SEQ ID NO: 35453 - protein, 111 aa, Artificial Sequence; identical to SEQ ID NO: 22600
  Description of Artificial Sequence: Synthetic polypeptide
  VL of XENP023044

SEQ ID NO: 35454 - protein, 15 aa, Artificial Sequence
  Description of Artificial Sequence: Synthetic peptide
  XENP023044 vlCDR1
RASQSVDYDGDSYMN

SEQ ID NO: 35455 - protein, 7 aa, Artificial Sequence
  Description of Artificial Sequence: Synthetic peptide
  XENP023044 vlCDR2
AASELES

SEQ ID NO: 35456 - protein, 9 aa, Artificial Sequence
  Description of Artificial Sequence: Synthetic peptide
  XENP023044 vlCDR3
QQSNEDPFT

SEQ ID NO: 35457 - protein, 226 aa, Artificial Sequence
  Description of Artificial Sequence: Synthetic polypeptide
  XENP023045 7G8_H3.70_L1.34_Fab Heavy Chain
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35458 - protein, 121 aa, Artificial Sequence
  Description of Artificial Sequence: Synthetic polypeptide
  VH of XENP023045
EVQLVESGGGLVQPGGSLRLSCAASGFTFDDAYMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 35459 - protein, 5 aa, Artificial Sequence
  Description of Artificial Sequence: Synthetic peptide
  XENP023045 vhCDR1
DAYMS

SEQ ID NO: 35460 - protein, 19 aa, Artificial Sequence
  Description of Artificial Sequence: Synthetic peptide
  XENP023045 vhCDR2
EISTKANNHATYYAESVKG

SEQ ID NO: 35461 - protein, 10 aa, Artificial Sequence
  Description of Artificial Sequence: Synthetic peptide
  XENP023045 vhCDR3
LATWDWYFDV

SEQ ID NO: 35462 - protein, 218 aa, Artificial Sequence; identical to SEQ ID NO: 22599
  Description of Artificial Sequence: Synthetic polypeptide
  XENP023045 7G8_H3.70_L1.34_Fab Light Chain

SEQ ID NO: 35463 - protein, 111 aa, Artificial Sequence; identical to SEQ ID NO: 22600
  Description of Artificial Sequence: Synthetic polypeptide
  VL of XENP023045

SEQ ID NO: 35464 - protein, 15 aa, Artificial Sequence
  Description of Artificial Sequence: Synthetic peptide
  XENP023045 vlCDR1
RASQSVDYDGDSYMN

SEQ ID NO: 35465 - protein, 7 aa, Artificial Sequence
  Description of Artificial Sequence: Synthetic peptide
  XENP023045 vlCDR2
AASELES

SEQ ID NO: 35466 - protein, 9 aa, Artificial Sequence
  Description of Artificial Sequence: Synthetic peptide
  XENP023045 vlCDR3
QQSNEDPFT

SEQ ID NO: 35467 - protein, 226 aa, Artificial Sequence
  Description of Artificial Sequence: Synthetic polypeptide
  XENP023046 7G8_H3.71_L1.34_Fab Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35468 - protein, 121 aa, Artificial Sequence
  Description of Artificial Sequence: Synthetic polypeptide
  VH of XENP023046
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 35469 - protein, 5 aa, Artificial Sequence
  Description of Artificial Sequence: Synthetic peptide
  XENP023046 vhCDR1
DAWMS

SEQ ID NO: 35470 - protein, 19 aa, Artificial Sequence
  Description of Artificial Sequence: Synthetic peptide
  XENP023046 vhCDR2
EISTKAYNHATYYAESVKG

SEQ ID NO: 35471 - protein, 10 aa, Artificial Sequence
  Description of Artificial Sequence: Synthetic peptide
  XENP023046 vhCDR3
LATWDWYFDV

SEQ ID NO: 35472 - protein, 218 aa, Artificial Sequence; identical to SEQ ID NO: 22599
  Description of Artificial Sequence: Synthetic polypeptide
  XENP023046 7G8_H3.71_L1.34_Fab Light Chain

SEQ ID NO: 35473 - protein, 111 aa, Artificial Sequence; identical to SEQ ID NO: 22600
  Description of Artificial Sequence: Synthetic polypeptide
  VL of XENP023046

SEQ ID NO: 35474 - protein, 15 aa, Artificial Sequence
  Description of Artificial Sequence: Synthetic peptide
  XENP023046 vlCDR1
RASQSVDYDGDSYMN

SEQ ID NO: 35475 - protein, 7 aa, Artificial Sequence
  Description of Artificial Sequence: Synthetic peptide
  XENP023046 vlCDR2
AASELES

SEQ ID NO: 35476 - protein, 9 aa, Artificial Sequence
  Description of Artificial Sequence: Synthetic peptide
  XENP023046 vlCDR3
QQSNEDPFT

SEQ ID NO: 35477 - protein, 226 aa, Artificial Sequence
  Description of Artificial Sequence: Synthetic polypeptide
  XENP023047 7G8_H3.72_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35478 - protein, 121 aa, Artificial Sequence
  Description of Artificial Sequence: Synthetic polypeptide
  VH of XENP023047
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATFDWYFDVWGQGTTVTVSS

SEQ ID NO: 35479 - protein, 5 aa, Artificial Sequence
  Description of Artificial Sequence: Synthetic peptide
  XENP023047 vhCDR1
DAWMS

SEQ ID NO: 35480 - protein, 19 aa, Artificial Sequence
  Description of Artificial Sequence: Synthetic peptide
  XENP023047 vhCDR2
EISTKANNHATYYAESVKG

SEQ ID NO: 35481 - protein, 10 aa, Artificial Sequence
  Description of Artificial Sequence: Synthetic peptide
  XENP023047 vhCDR3
LATFDWYFDV

SEQ ID NO: 35482 - protein, 218 aa, Artificial Sequence; identical to SEQ ID NO: 22599
  Description of Artificial Sequence: Synthetic polypeptide
  XENP023047 7G8_H3.72_L1.34_Fab Light Chain

SEQ ID NO: 35483 - protein, 111 aa, Artificial Sequence; identical to SEQ ID NO: 22600
  Description of Artificial Sequence: Synthetic polypeptide
  VL of XENP023047

SEQ ID NO: 35484 - protein, 15 aa, Artificial Sequence
  Description of Artificial Sequence: Synthetic peptide
  XENP023047 vlCDR1
RASQSVDYDGDSYMN

SEQ ID NO: 35485 - protein, 7 aa, Artificial Sequence
  Description of Artificial Sequence: Synthetic peptide
  XENP023047 vlCDR2
AASELES

SEQ ID NO: 35486 - protein, 9 aa, Artificial Sequence
  Description of Artificial Sequence: Synthetic peptide
  XENP023047 vlCDR3
QQSNEDPFT

SEQ ID NO: 35487 - protein, 226 aa, Artificial Sequence
  Description of Artificial Sequence: Synthetic polypeptide
  XENP023048 7G8_H3.73_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35488 - protein, 121 aa, Artificial Sequence
  Description of Artificial Sequence: Synthetic polypeptide
  VH of XENP023048
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATYDWYFDVWGQGTTVTVSS

SEQ ID NO: 35489 - protein, 5 aa, Artificial Sequence
  Description of Artificial Sequence: Synthetic peptide
  XENP023048 vhCDR1
DAWMS

SEQ ID NO: 35490 - protein, 19 aa, Artificial Sequence
  Description of Artificial Sequence: Synthetic peptide
  XENP023048 vhCDR2
EISTKANNHATYYAESVKG

SEQ ID NO: 35491 - protein, 10 aa, Artificial Sequence
  Description of Artificial Sequence: Synthetic peptide
  XENP023048 vhCDR3
LATYDWYFDV

SEQ ID NO: 35492 - protein, 218 aa, Artificial Sequence; identical to SEQ ID NO: 22599
  Description of Artificial Sequence: Synthetic polypeptide
  XENP023048 7G8_H3.73_L1.34_Fab Light Chain

SEQ ID NO: 35493 - protein, 111 aa, Artificial Sequence; identical to SEQ ID NO: 22600
  Description of Artificial Sequence: Synthetic polypeptide
  VL of XENP023048

SEQ ID NO: 35494 - protein, 15 aa, Artificial Sequence
  Description of Artificial Sequence: Synthetic peptide
  XENP023048 vlCDR1
RASQSVDYDGDSYMN

SEQ ID NO: 35495 - protein, 7 aa, Artificial Sequence
  Description of Artificial Sequence: Synthetic peptide
  XENP023048 vlCDR2
AASELES

SEQ ID NO: 35496 - protein, 9 aa, Artificial Sequence
  Description of Artificial Sequence: Synthetic peptide
  XENP023048 vlCDR3
QQSNEDPFT

SEQ ID NO: 35497 - protein, 226 aa, Artificial Sequence
  Description of Artificial Sequence: Synthetic polypeptide
  XENP023049 7G8_H3.74_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35498 - protein, 121 aa, Artificial Sequence
  Description of Artificial Sequence: Synthetic polypeptide
  VH of XENP023049
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDFYFDVWGQGTTVTVSS

SEQ ID NO: 35499 - protein, 5 aa, Artificial Sequence
  Description of Artificial Sequence: Synthetic peptide
  XENP023049 vhCDR1
DAWMS

SEQ ID NO: 35500 - protein, 19 aa, Artificial Sequence
  Description of Artificial Sequence: Synthetic peptide
  XENP023049 vhCDR2
EISTKANNHATYYAESVKG

SEQ ID NO: 35501 - protein, 10 aa, Artificial Sequence
  Description of Artificial Sequence: Synthetic peptide
  XENP023049 vhCDR3
LATWDFYFDV

SEQ ID NO: 35502 - protein, 218 aa, Artificial Sequence; identical to SEQ ID NO: 22599
  Description of Artificial Sequence: Synthetic polypeptide
  XENP023049 7G8_H3.74_L1.34_Fab Light Chain

SEQ ID NO: 35503 - protein, 111 aa, Artificial Sequence; identical to SEQ ID NO: 22600
  Description of Artificial Sequence: Synthetic polypeptide
  VL of XENP023049

SEQ ID NO: 35504 - protein, 15 aa, Artificial Sequence
  Description of Artificial Sequence: Synthetic peptide
  XENP023049 vlCDR1
RASQSVDYDGDSYMN

SEQ ID NO: 35505 - protein, 7 aa, Artificial Sequence
  Description of Artificial Sequence: Synthetic peptide
  XENP023049 vlCDR2
AASELES

SEQ ID NO: 35506 - protein, 9 aa, Artificial Sequence
  Description of Artificial Sequence: Synthetic peptide
  XENP023049 vlCDR3
QQSNEDPFT

SEQ ID NO: 35507 - protein, 226 aa, Artificial Sequence
  Description of Artificial Sequence: Synthetic polypeptide
  XENP023050 7G8_H3.75_L1.34_Fab Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 35508 - protein, 121 aa, Artificial Sequence
  Description of Artificial Sequence: Synthetic polypeptide
  VH of XENP023050
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDYYFDVWGQGTTVTVSS

SEQ ID NO: 35509 - protein, 5 aa, Artificial Sequence
  Description of Artificial Sequence: Synthetic peptide
  XENP023050 vhCDR1
DAWMS

SEQ ID NO: 35510 - protein, 19 aa, Artificial Sequence
  Description of Artificial Sequence: Synthetic peptide
  XENP023050 vhCDR2
EISTKANNHATYYAESVKG

SEQ ID NO: 35511 - protein, 10 aa, Artificial Sequence
  Description of Artificial Sequence: Synthetic peptide
  XENP023050 vhCDR3
LATWDYYFDV

SEQ ID NO: 35512 - protein, 218 aa, Artificial Sequence; identical to SEQ ID NO: 22599
  Description of Artificial Sequence: Synthetic polypeptide
  XENP023050 7G8_H3.75_L1.34_Fab Light Chain

SEQ ID NO: 35513 - protein, 111 aa, Artificial Sequence; identical to SEQ ID NO: 22600
  Description of Artificial Sequence: Synthetic polypeptide
  VL of XENP023050

SEQ ID NO: 35514 - protein, 15 aa, Artificial Sequence
  Description of Artificial Sequence: Synthetic peptide
  XENP023050 vlCDR1
RASQSVDYDGDSYMN

SEQ ID NO: 35515 - protein, 7 aa, Artificial Sequence
  Description of Artificial Sequence: Synthetic peptide
  XENP023050 vlCDR2
AASELES

SEQ ID NO: 35516 - protein, 9 aa, Artificial Sequence
  Description of Artificial Sequence: Synthetic peptide
  XENP023050 vlCDR3
QQSNEDPFT

SEQ ID NO: 35517 - protein, 226 aa, Artificial Sequence; identical to SEQ ID NO: 32254
  Description of Artificial Sequence: Synthetic polypeptide
  XENP023051 7G8_H3.30_L1.38_Fab Heavy Chain

SEQ ID NO: 35518 - protein, 121 aa, Artificial Sequence; identical to SEQ ID NO: 22485
  Description of Artificial Sequence: Synthetic polypeptide
  VH of XENP023051

SEQ ID NO: 35519 - protein, 5 aa, Artificial Sequence
  Description of Artificial Sequence: Synthetic peptide
  XENP023051 vhCDR1
DAWMS

SEQ ID NO: 35520 - protein, 19 aa, Artificial Sequence
  Description of Artificial Sequence: Synthetic peptide
  XENP023051 vhCDR2
EISTKANNHATYYAESVKG

SEQ ID NO: 35521 - protein, 10 aa, Artificial Sequence
  Description of Artificial Sequence: Synthetic peptide
  XENP023051 vhCDR3
LATWDWYFDV

SEQ ID NO: 35522 - protein, 218 aa, Artificial Sequence
  Description of Artificial Sequence: Synthetic polypeptide
  XENP023051 7G8_H3.30_L1.38_Fab Light Chain
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35523 - protein, 111 aa, Artificial Sequence
  Description of Artificial Sequence: Synthetic polypeptide
  VL of XENP023051
DIVLTQSPSSLSASVGDRVTITCRASQSVDYEGDSYMNWYQQKPGKPPKLLIYAASELESGIPARFSGSGSGTDFTLTISSLQPEDFATYYCQQSNEDPFTFGSGTKLEIK

SEQ ID NO: 35524 - protein, 15 aa, Artificial Sequence
  Description of Artificial Sequence: Synthetic peptide
  XENP023051 vlCDR1
RASQSVDYEGDSYMN

SEQ ID NO: 35525 - protein, 7 aa, Artificial Sequence
  Description of Artificial Sequence: Synthetic peptide
  XENP023051 vlCDR2
AASELES

SEQ ID NO: 35526 - protein, 9 aa, Artificial Sequence
  Description of Artificial Sequence: Synthetic peptide
  XENP023051 vlCDR3
QQSNEDPFT

SEQ ID NO: 35527 - protein, 226 aa, Artificial Sequence; identical to SEQ ID NO: 32254
  Description of Artificial Sequence: Synthetic polypeptide
  XENP023052 7G8_H3.30_L1.39_Fab Heavy Chain

SEQ ID NO: 35528 - protein, 121 aa, Artificial Sequence; identical to SEQ ID NO: 22485
  Description of Artificial Sequence: Synthetic polypeptide
  VH of XENP023052

SEQ ID NO: 35529 - protein, 5 aa, Artificial Sequence
  Description of Artificial Sequence: Synthetic peptide
  XENP023052 vhCDR1
DAWMS

SEQ ID NO: 35530 - protein, 19 aa, Artificial Sequence
  Description of Artificial Sequence: Synthetic peptide
  XENP023052 vhCDR2
EISTKANNHATYYAESVKG

SEQ ID NO: 35531 - protein, 10 aa, Artificial Sequence
  Description of Artificial Sequence: Synthetic peptide
  XENP023052 vhCDR3
LATWDWYFDV

SEQ ID NO: 35532 - protein, 218 aa, Artificial Sequence
  Description of Artificial Sequence: Synthetic polypeptide
  XENP023052 7G8_H3.30_L1.39_Fab Light Chain
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35533 - protein, 111 aa, Artificial Sequence
  Description of Artificial Sequence: Synthetic polypeptide
  VL of XENP023052
DIVLTQSPSSLSASVGDRVTITCRASQSVDYYGDSYMNWYQQKPGKPPKLLIYAASELESGIPARFSGSGSGTDFTLTISSLQPEDFATYYCQQSNEDPFTFGSGTKLEIK

SEQ ID NO: 35534 - protein, 15 aa, Artificial Sequence
  Description of Artificial Sequence: Synthetic peptide
  XENP023052 vlCDR1
RASQSVDYYGDSYMN

SEQ ID NO: 35535 - protein, 7 aa, Artificial Sequence
  Description of Artificial Sequence: Synthetic peptide
  XENP023052 vlCDR2
AASELES

SEQ ID NO: 35536 - protein, 9 aa, Artificial Sequence
  Description of Artificial Sequence: Synthetic peptide
  XENP023052 vlCDR3
QQSNEDPFT

SEQ ID NO: 35537 - protein, 226 aa, Artificial Sequence; identical to SEQ ID NO: 32254
  Description of Artificial Sequence: Synthetic polypeptide
  XENP023053 7G8_H3.30_L1.40_Fab Heavy Chain

SEQ ID NO: 35538 - protein, 121 aa, Artificial Sequence; identical to SEQ ID NO: 22485
  Description of Artificial Sequence: Synthetic polypeptide
  VH of XENP023053

SEQ ID NO: 35539 - protein, 5 aa, Artificial Sequence
  Description of Artificial Sequence: Synthetic peptide
  XENP023053 vhCDR1
DAWMS

SEQ ID NO: 35540 - protein, 19 aa, Artificial Sequence
  Description of Artificial Sequence: Synthetic peptide
  XENP023053 vhCDR2
EISTKANNHATYYAESVKG

SEQ ID NO: 35541 - protein, 10 aa, Artificial Sequence
  Description of Artificial Sequence: Synthetic peptide
  XENP023053 vhCDR3
LATWDWYFDV

SEQ ID NO: 35542 - protein, 218 aa, Artificial Sequence
  Description of Artificial Sequence: Synthetic polypeptide
  XENP023053 7G8_H3.30_L1.40_Fab Light Chain
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35543 - protein, 111 aa, Artificial Sequence
  Description of Artificial Sequence: Synthetic polypeptide
  VL of XENP023053
DIVLTQSPSSLSASVGDRVTITCRASQSVDYDADSYMNWYQQKPGKPPKLLIYAASELESGIPARFSGSGSGTDFTLTISSLQPEDFATYYCQQSNEDPFTFGSGTKLEIK

SEQ ID NO: 35544 - protein, 15 aa, Artificial Sequence
  Description of Artificial Sequence: Synthetic peptide
  XENP023053 vlCDR1
RASQSVDYDADSYMN

SEQ ID NO: 35545 - protein, 7 aa, Artificial Sequence
  Description of Artificial Sequence: Synthetic peptide
  XENP023053 vlCDR2
AASELES

SEQ ID NO: 35546 - protein, 9 aa, Artificial Sequence
  Description of Artificial Sequence: Synthetic peptide
  XENP023053 vlCDR3
QQSNEDPFT

SEQ ID NO: 35547 - protein, 226 aa, Artificial Sequence; identical to SEQ ID NO: 32254
  Description of Artificial Sequence: Synthetic polypeptide
  XENP023054 7G8_H3.30_L1.41_Fab Heavy Chain

SEQ ID NO: 35548 - protein, 121 aa, Artificial Sequence; identical to SEQ ID NO: 22485
  Description of Artificial Sequence: Synthetic polypeptide
  VH of XENP023054

SEQ ID NO: 35549 - protein, 5 aa, Artificial Sequence
  Description of Artificial Sequence: Synthetic peptide
  XENP023054 vhCDR1
DAWMS

SEQ ID NO: 35550 - protein, 19 aa, Artificial Sequence
  Description of Artificial Sequence: Synthetic peptide
  XENP023054 vhCDR2
EISTKANNHATYYAESVKG

SEQ ID NO: 35551 - protein, 10 aa, Artificial Sequence
  Description of Artificial Sequence: Synthetic peptide
  XENP023054 vhCDR3
LATWDWYFDV

SEQ ID NO: 35552 - protein, 218 aa, Artificial Sequence
  Description of Artificial Sequence: Synthetic polypeptide
  XENP023054 7G8_H3.30_L1.41_Fab Light Chain
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35553 - protein, 111 aa, Artificial Sequence
  Description of Artificial Sequence: Synthetic polypeptide
  VL of XENP023054
DIVLTQSPSSLSASVGDRVTITCRASQSVDYDQDSYMNWYQQKPGKPPKLLIYAASELESGIPARFSGSGSGTDFTLTISSLQPEDFATYYCQQSNEDPFTFGSGTKLEIK

SEQ ID NO: 35554 - protein, 15 aa, Artificial Sequence
  Description of Artificial Sequence: Synthetic peptide
  XENP023054 vlCDR1
RASQSVDYDQDSYMN

SEQ ID NO: 35555 - protein, 7 aa, Artificial Sequence
  Description of Artificial Sequence: Synthetic peptide
  XENP023054 vlCDR2
AASELES

SEQ ID NO: 35556 - protein, 9 aa, Artificial Sequence
  Description of Artificial Sequence: Synthetic peptide
  XENP023054 vlCDR3
QQSNEDPFT

SEQ ID NO: 35557 - protein, 226 aa, Artificial Sequence; identical to SEQ ID NO: 32254
  Description of Artificial Sequence: Synthetic polypeptide
  XENP023055 7G8_H3.30_L1.42_Fab Heavy Chain

SEQ ID NO: 35558 - protein, 121 aa, Artificial Sequence; identical to SEQ ID NO: 22485
  Description of Artificial Sequence: Synthetic polypeptide
  VH of XENP023055

SEQ ID NO: 35559 - protein, 5 aa, Artificial Sequence
  Description of Artificial Sequence: Synthetic peptide
  XENP023055 vhCDR1
DAWMS

SEQ ID NO: 35560 - protein, 19 aa, Artificial Sequence
  Description of Artificial Sequence: Synthetic peptide
  XENP023055 vhCDR2
EISTKANNHATYYAESVKG

SEQ ID NO: 35561 - protein, 10 aa, Artificial Sequence
  Description of Artificial Sequence: Synthetic peptide
  XENP023055 vhCDR3
LATWDWYFDV

SEQ ID NO: 35562 - protein, 218 aa, Artificial Sequence
  Description of Artificial Sequence: Synthetic polypeptide
  XENP023055 7G8_H3.30_L1.42_Fab Light Chain
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35563 - protein, 111 aa, Artificial Sequence
  Description of Artificial Sequence: Synthetic polypeptide
  VL of XENP023055
DIVLTQSPSSLSASVGDRVTITCRASQSVDYDDDSYMNWYQQKPGKPPKLLIYAASELESGIPARFSGSGSGTDFTLTISSLQPEDFATYYCQQSNEDPFTFGSGTKLEIK

SEQ ID NO: 35564 - protein, 15 aa, Artificial Sequence
  Description of Artificial Sequence: Synthetic peptide
  XENP023055 vlCDR1
RASQSVDYDDDSYMN

SEQ ID NO: 35565 - protein, 7 aa, Artificial Sequence
  Description of Artificial Sequence: Synthetic peptide
  XENP023055 vlCDR2
AASELES

SEQ ID NO: 35566 - protein, 9 aa, Artificial Sequence
  Description of Artificial Sequence: Synthetic peptide
  XENP023055 vlCDR3
QQSNEDPFT

SEQ ID NO: 35567 - protein, 226 aa, Artificial Sequence; identical to SEQ ID NO: 32254
  Description of Artificial Sequence: Synthetic polypeptide
  XENP023056 7G8_H3.30_L1.43_Fab Heavy Chain

SEQ ID NO: 35568 - protein, 121 aa, Artificial Sequence; identical to SEQ ID NO: 22485
  Description of Artificial Sequence: Synthetic polypeptide
  VH of XENP023056

SEQ ID NO: 35569 - protein, 5 aa, Artificial Sequence
  Description of Artificial Sequence: Synthetic peptide
  XENP023056 vhCDR1
DAWMS

SEQ ID NO: 35570 - protein, 19 aa, Artificial Sequence
  Description of Artificial Sequence: Synthetic peptide
  XENP023056 vhCDR2
EISTKANNHATYYAESVKG

SEQ ID NO: 35571 - protein, 10 aa, Artificial Sequence
  Description of Artificial Sequence: Synthetic peptide
  XENP023056 vhCDR3
LATWDWYFDV

SEQ ID NO: 35572 - protein, 218 aa, Artificial Sequence
  Description of Artificial Sequence: Synthetic polypeptide
  XENP023056 7G8_H3.30_L1.43_Fab Light Chain
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35573 - protein, 111 aa, Artificial Sequence
  Description of Artificial Sequence: Synthetic polypeptide
  VL of XENP023056
DIVLTQSPSSLSASVGDRVTITCRASQSVDYDYDSYMNWYQQKPGKPPKLLIYAASELESGIPARFSGSGSGTDFTLTISSLQPEDFATYYCQQSNEDPFTFGSGTKLEIK

SEQ ID NO: 35574 - protein, 15 aa, Artificial Sequence
  Description of Artificial Sequence: Synthetic peptide
  XENP023056 vlCDR1
RASQSVDYDYDSYMN

SEQ ID NO: 35575 - protein, 7 aa, Artificial Sequence
  Description of Artificial Sequence: Synthetic peptide
  XENP023056 vlCDR2
AASELES

SEQ ID NO: 35576 - protein, 9 aa, Artificial Sequence
  Description of Artificial Sequence: Synthetic peptide
  XENP023056 vlCDR3
QQSNEDPFT

SEQ ID NO: 35577 - protein, 226 aa, Artificial Sequence; identical to SEQ ID NO: 35417
  Description of Artificial Sequence: Synthetic polypeptide
  XENP023220 7G8_H3.66_L1.39_Fab Heavy Chain

SEQ ID NO: 35578 - protein, 121 aa, Artificial Sequence; identical to SEQ ID NO: 35418
  Description of Artificial Sequence: Synthetic polypeptide
  VH of XENP023220

SEQ ID NO: 35579 - protein, 5 aa, Artificial Sequence
  Description of Artificial Sequence: Synthetic peptide
  XENP023220 vhCDR1
EAWMS

SEQ ID NO: 35580 - protein, 19 aa, Artificial Sequence
  Description of Artificial Sequence: Synthetic peptide
  XENP023220 vhCDR2
EISTKANNHATYYAESVKG

SEQ ID NO: 35581 - protein, 10 aa, Artificial Sequence
  Description of Artificial Sequence: Synthetic peptide
  XENP023220 vhCDR3
LATWDWYFDV

SEQ ID NO: 35582 - protein, 218 aa, Artificial Sequence; identical to SEQ ID NO: 35532
  Description of Artificial Sequence: Synthetic polypeptide
  XENP023220 7G8_H3.66_L1.39_Fab Light Chain

SEQ ID NO: 35583 - protein, 111 aa, Artificial Sequence; identical to SEQ ID NO: 35533
  Description of Artificial Sequence: Synthetic polypeptide
  VL of XENP023220

SEQ ID NO: 35584 - protein, 15 aa, Artificial Sequence
  Description of Artificial Sequence: Synthetic peptide
  XENP023220 vlCDR1
RASQSVDYYGDSYMN

SEQ ID NO: 35585 - protein, 7 aa, Artificial Sequence
  Description of Artificial Sequence: Synthetic peptide
  XENP023220 vlCDR2
AASELES

SEQ ID NO: 35586 - protein, 9 aa, Artificial Sequence
  Description of Artificial Sequence: Synthetic peptide
  XENP023220 vlCDR3
QQSNEDPFT

SEQ ID NO: 35587 - protein, 226 aa, Artificial Sequence; identical to SEQ ID NO: 35427
  Description of Artificial Sequence: Synthetic polypeptide
  XENP023221 7G8_H3.67_L1.39_Fab Heavy Chain

SEQ ID NO: 35588 - protein, 121 aa, Artificial Sequence; identical to SEQ ID NO: 35428
  Description of Artificial Sequence: Synthetic polypeptide
  VH of XENP023221

SEQ ID NO: 35589 - protein, 5 aa, Artificial Sequence
  Description of Artificial Sequence: Synthetic peptide
  XENP023221 vhCDR1
DTWMS

SEQ ID NO: 35590 - protein, 19 aa, Artificial Sequence
  Description of Artificial Sequence: Synthetic peptide
  XENP023221 vhCDR2
EISTKANNHATYYAESVKG

SEQ ID NO: 35591 - protein, 10 aa, Artificial Sequence
  Description of Artificial Sequence: Synthetic peptide
  XENP023221 vhCDR3
LATWDWYFDV

SEQ ID NO: 35592 - protein, 218 aa, Artificial Sequence; identical to SEQ ID NO: 35532
  Description of Artificial Sequence: Synthetic polypeptide
  XENP023221 7G8_H3.67_L1.39_Fab Light Chain

SEQ ID NO: 35593 - protein, 111 aa, Artificial Sequence; identical to SEQ ID NO: 35533
  Description of Artificial Sequence: Synthetic polypeptide
  VL of XENP023221

SEQ ID NO: 35594 - protein, 15 aa, Artificial Sequence
  Description of Artificial Sequence: Synthetic peptide
  XENP023221 vlCDR1
RASQSVDYYGDSYMN

SEQ ID NO: 35595 - protein, 7 aa, Artificial Sequence
  Description of Artificial Sequence: Synthetic peptide
  XENP023221 vlCDR2
AASELES

SEQ ID NO: 35596 - protein, 9 aa, Artificial Sequence
  Description of Artificial Sequence: Synthetic peptide
  XENP023221 vlCDR3
QQSNEDPFT

SEQ ID NO: 35597 - protein, 226 aa, Artificial Sequence; identical to SEQ ID NO: 35467
  Description of Artificial Sequence: Synthetic polypeptide
  XENP023222 7G8_H3.71_L1.39_Fab Heavy Chain

SEQ ID NO: 35598 - protein, 121 aa, Artificial Sequence; identical to SEQ ID NO: 35468
  Description of Artificial Sequence: Synthetic polypeptide
  VH of XENP023222

SEQ ID NO: 35599 - protein, 5 aa, Artificial Sequence
  Description of Artificial Sequence: Synthetic peptide
  XENP023222 vhCDR1
DAWMS

SEQ ID NO: 35600 - protein, 19 aa, Artificial Sequence
  Description of Artificial Sequence: Synthetic peptide
  XENP023222 vhCDR2
EISTKAYNHATYYAESVKG

SEQ ID NO: 35601 - protein, 10 aa, Artificial Sequence
  Description of Artificial Sequence: Synthetic peptide
  XENP023222 vhCDR3
LATWDWYFDV

SEQ ID NO: 35602 - protein, 218 aa, Artificial Sequence; identical to SEQ ID NO: 35532
  Description of Artificial Sequence: Synthetic polypeptide
  XENP023222 7G8_H3.71_L1.39_Fab Light Chain

SEQ ID NO: 35603 - protein, 111 aa, Artificial Sequence; identical to SEQ ID NO: 35533
  Description of Artificial Sequence: Synthetic polypeptide
  VL of XENP023222

SEQ ID NO: 35604 - protein, 15 aa, Artificial Sequence
  Description of Artificial Sequence: Synthetic peptide
  XENP023222 vlCDR1
RASQSVDYYGDSYMN

SEQ ID NO: 35605 - protein, 7 aa, Artificial Sequence
  Description of Artificial Sequence: Synthetic peptide
  XENP023222 vlCDR2
AASELES

SEQ ID NO: 35606 - protein, 9 aa, Artificial Sequence
  Description of Artificial Sequence: Synthetic peptide
  XENP023222 vlCDR3
QQSNEDPFT

SEQ ID NO: 35607 - protein, 450 aa, Artificial Sequence
  Description of Artificial Sequence: Synthetic polypeptide
  XENP022841 7G8_H3.30_L1.34_Fab-[CTLA-4]_H3.23_L0.129_scFv Fab -Fc Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35608 - protein, 121 aa, Artificial Sequence; identical to SEQ ID NO: 22485
  Description of Artificial Sequence: Synthetic polypeptide
  VH of XENP022841

SEQ ID NO: 35609 - protein, 5 aa, Artificial Sequence
  Description of Artificial Sequence: Synthetic peptide
  XENP022841 vhCDR1
DAWMS

SEQ ID NO: 35610 - protein, 19 aa, Artificial Sequence
  Description of Artificial Sequence: Synthetic peptide
  XENP022841 vhCDR2
EISTKANNHATYYAESVKG

SEQ ID NO: 35611 - protein, 10 aa, Artificial Sequence
  Description of Artificial Sequence: Synthetic peptide
  XENP022841 vhCDR3
LATWDWYFDV

SEQ ID NO: 35612 - protein, 477 aa, Artificial Sequence
  Description of Artificial Sequence: Synthetic polypeptide
  XENP022841 7G8_H3.30_L1.34_Fab-[CTLA-4]_H3.23_L0.129_scFv scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 35613 - protein, 118 aa, Artificial Sequence; identical to SEQ ID NO: 2632
  Description of Artificial Sequence: Synthetic polypeptide
  VH of XENP022841

SEQ ID NO: 35614 - protein, 108 aa, Artificial Sequence; identical to SEQ ID NO: 2768
  Description of Artificial Sequence: Synthetic polypeptide
  VL of XENP022841

SEQ ID NO: 35615 - protein, 231 aa, Artificial Sequence; identical to SEQ ID NO: 21572
  Description of Artificial Sequence: Synthetic polypeptide
  Fc chain of XENP022841

SEQ ID NO: 35616 - protein, 5 aa, Artificial Sequence
  Description of Artificial Sequence: Synthetic peptide
  XENP022841 vhCDR1
SYTMH

SEQ ID NO: 35617 - protein, 17 aa, Artificial Sequence
  Description of Artificial Sequence: Synthetic peptide
  XENP022841 vhCDR2
FISYDGNYKYYADSVKG

SEQ ID NO: 35618 - protein, 9 aa, Artificial Sequence
  Description of Artificial Sequence: Synthetic peptide
  XENP022841 vhCDR3
GGHLGPFDL

SEQ ID NO: 35619 - protein, 12 aa, Artificial Sequence
  Description of Artificial Sequence: Synthetic peptide
  XENP022841 vlCDR1
RASQSVGSSYLA

SEQ ID NO: 35620 - protein, 7 aa, Artificial Sequence
  Description of Artificial Sequence: Synthetic peptide
  XENP022841 vlCDR2
GASSRAT

SEQ ID NO: 35621 - protein, 9 aa, Artificial Sequence
  Description of Artificial Sequence: Synthetic peptide
  XENP022841 vlCDR3
QQYGSSPWT

SEQ ID NO: 35622 - protein, 218 aa, Artificial Sequence; identical to SEQ ID NO: 22599
  Description of Artificial Sequence: Synthetic polypeptide
  XENP022841 7G8_H3.30_L1.34_Fab-[CTLA-4]_H3.23_L0.129_scFv Light Chain

SEQ ID NO: 35623 - protein, 111 aa, Artificial Sequence; identical to SEQ ID NO: 22600
  Description of Artificial Sequence: Synthetic polypeptide
  VL of XENP022841

SEQ ID NO: 35624 - protein, 15 aa, Artificial Sequence
  Description of Artificial Sequence: Synthetic peptide
  XENP022841 vlCDR1
RASQSVDYDGDSYMN

SEQ ID NO: 35625 - protein, 7 aa, Artificial Sequence
  Description of Artificial Sequence: Synthetic peptide
  XENP022841 vlCDR2
AASELES

SEQ ID NO: 35626 - protein, 9 aa, Artificial Sequence
  Description of Artificial Sequence: Synthetic peptide
  XENP022841 vlCDR3
QQSNEDPFT

SEQ ID NO: 35627 - protein, 450 aa, Artificial Sequence; identical to SEQ ID NO: 35607
  Description of Artificial Sequence: Synthetic polypeptide
  XENP022842 7G8_H3.30_L1.36_Fab-[CTLA-4]_H3.23_L0.129_scFv Fab-Fc Heavy Chain

SEQ ID NO: 35628 - protein, 121 aa, Artificial Sequence; identical to SEQ ID NO: 22485
  Description of Artificial Sequence: Synthetic polypeptide
  VH of XENP022842

SEQ ID NO: 35629 - protein, 5 aa, Artificial Sequence
  Description of Artificial Sequence: Synthetic peptide
  XENP022842 vhCDR1
DAWMS

SEQ ID NO: 35630 - protein, 19 aa, Artificial Sequence
  Description of Artificial Sequence: Synthetic peptide
  XENP022842 vhCDR2
EISTKANNHATYYAESVKG

SEQ ID NO: 35631 - protein, 10 aa, Artificial Sequence
  Description of Artificial Sequence: Synthetic peptide
  XENP022842 vhCDR3
LATWDWYFDV

SEQ ID NO: 35632 - protein, 477 aa, Artificial Sequence; identical to SEQ ID NO: 35612
  Description of Artificial Sequence: Synthetic polypeptide
  XENP022842 7G8_H3.30_L1.36_Fab-[CTLA-4]_H3.23_L0.129_scFv sc Fv-Fc Heavy Chain

SEQ ID NO: 35633 - protein, 118 aa, Artificial Sequence; identical to SEQ ID NO: 2632
  Description of Artificial Sequence: Synthetic polypeptide
  VH of XENP022842

SEQ ID NO: 35634 - protein, 108 aa, Artificial Sequence; identical to SEQ ID NO: 2768
  Description of Artificial Sequence: Synthetic polypeptide
  VL of XENP022842

SEQ ID NO: 35635 - protein, 231 aa, Artificial Sequence; identical to SEQ ID NO: 21572
  Description of Artificial Sequence: Synthetic polypeptide
  Fc chain of XENP022842

SEQ ID NO: 35636 - protein, 5 aa, Artificial Sequence
  Description of Artificial Sequence: Synthetic peptide
  XENP022842 vhCDR1
SYTMH

SEQ ID NO: 35637 - protein, 17 aa, Artificial Sequence
  Description of Artificial Sequence: Synthetic peptide
  XENP022842 vhCDR2
FISYDGNYKYYADSVKG

SEQ ID NO: 35638 - protein, 9 aa, Artificial Sequence
  Description of Artificial Sequence: Synthetic peptide
  XENP022842 vhCDR3
GGHLGPFDL

SEQ ID NO: 35639 - protein, 12 aa, Artificial Sequence
  Description of Artificial Sequence: Synthetic peptide
  XENP022842 vlCDR1
RASQSVGSSYLA

SEQ ID NO: 35640 - protein, 7 aa, Artificial Sequence
  Description of Artificial Sequence: Synthetic peptide
  XENP022842 vlCDR2
GASSRAT

SEQ ID NO: 35641 - protein, 9 aa, Artificial Sequence
  Description of Artificial Sequence: Synthetic peptide
  XENP022842 vlCDR3
QQYGSSPWT

SEQ ID NO: 35642 - protein, 218 aa, Artificial Sequence; identical to SEQ ID NO: 22619
  Description of Artificial Sequence: Synthetic polypeptide
  XENP022842 7G8_H3.30_L1.36_Fab-[CTLA-4]_H3.23_L0.129_scFv Light Chain

SEQ ID NO: 35643 - protein, 111 aa, Artificial Sequence; identical to SEQ ID NO: 22620
  Description of Artificial Sequence: Synthetic polypeptide
  VL of XENP022842

SEQ ID NO: 35644 - protein, 15 aa, Artificial Sequence
  Description of Artificial Sequence: Synthetic peptide
  XENP022842 vlCDR1
RASQSVDHDGDSYMN

SEQ ID NO: 35645 - protein, 7 aa, Artificial Sequence
  Description of Artificial Sequence: Synthetic peptide
  XENP022842 vlCDR2
AASELES

SEQ ID NO: 35646 - protein, 9 aa, Artificial Sequence
  Description of Artificial Sequence: Synthetic peptide
  XENP022842 vlCDR3
QQSNEDPFT

SEQ ID NO: 35647 - protein, 447 aa, Artificial Sequence
  Description of Artificial Sequence: Synthetic polypeptide
  XENP022843 2A11_H1.144_L2.142_Fab-[CTLA-4]_H3.23_L0.129_scFv Fab-Fc Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35648 - protein, 118 aa, Artificial Sequence; identical to SEQ ID NO: 22085
  Description of Artificial Sequence: Synthetic polypeptide
  VH of XENP022843

SEQ ID NO: 35649 - protein, 5 aa, Artificial Sequence
  Description of Artificial Sequence: Synthetic peptide
  XENP022843 vhCDR1
DYFMH

SEQ ID NO: 35650 - protein, 17 aa, Artificial Sequence
  Description of Artificial Sequence: Synthetic peptide
  XENP022843 vhCDR2
WIDPELGDTEYAPKFQG

SEQ ID NO: 35651 - protein, 9 aa, Artificial Sequence
  Description of Artificial Sequence: Synthetic peptide
  XENP022843 vhCDR3
RGVYQALDY

SEQ ID NO: 35652 - protein, 477 aa, Artificial Sequence; identical to SEQ ID NO: 35612
  Description of Artificial Sequence: Synthetic polypeptide
  XENP022843 2A11_H1.144_L2.142_Fab-[CTLA-4]_H3.23_L0.129_scFv scFv-Fc Heavy Chain

SEQ ID NO: 35653 - protein, 118 aa, Artificial Sequence; identical to SEQ ID NO: 2632
  Description of Artificial Sequence: Synthetic polypeptide
  VH of XENP022843

SEQ ID NO: 35654 - protein, 108 aa, Artificial Sequence; identical to SEQ ID NO: 2768
  Description of Artificial Sequence: Synthetic polypeptide
  VL of XENP022843

SEQ ID NO: 35655 - protein, 231 aa, Artificial Sequence; identical to SEQ ID NO: 21572
  Description of Artificial Sequence: Synthetic polypeptide
  Fc chain of XENP022843

SEQ ID NO: 35656 - protein, 5 aa, Artificial Sequence
  Description of Artificial Sequence: Synthetic peptide
  XENP022843 vhCDR1
SYTMH

SEQ ID NO: 35657 - protein, 17 aa, Artificial Sequence
  Description of Artificial Sequence: Synthetic peptide
  XENP022843 vhCDR2
FISYDGNYKYYADSVKG

SEQ ID NO: 35658 - protein, 9 aa, Artificial Sequence
  Description of Artificial Sequence: Synthetic peptide
  XENP022843 vhCDR3
GGHLGPFDL

SEQ ID NO: 35659 - protein, 12 aa, Artificial Sequence
  Description of Artificial Sequence: Synthetic peptide
  XENP022843 vlCDR1
RASQSVGSSYLA

SEQ ID NO: 35660 - protein, 7 aa, Artificial Sequence
  Description of Artificial Sequence: Synthetic peptide
  XENP022843 vlCDR2
GASSRAT

SEQ ID NO: 35661 - protein, 9 aa, Artificial Sequence
  Description of Artificial Sequence: Synthetic peptide
  XENP022843 vlCDR3
QQYGSSPWT

SEQ ID NO: 35662 - protein, 214 aa, Artificial Sequence; identical to SEQ ID NO: 22279
  Description of Artificial Sequence: Synthetic polypeptide
  XENP022843 2A11_H1.144_L2.142_Fab-[CTLA-4]_H3.23_L0.129_scFv Light Chain

SEQ ID NO: 35663 - protein, 107 aa, Artificial Sequence; identical to SEQ ID NO: 22280
  Description of Artificial Sequence: Synthetic polypeptide
  VL of XENP022843

SEQ ID NO: 35664 - protein, 11 aa, Artificial Sequence
  Description of Artificial Sequence: Synthetic peptide
  XENP022843 vlCDR1
QASQDIGNYLN

SEQ ID NO: 35665 - protein, 7 aa, Artificial Sequence
  Description of Artificial Sequence: Synthetic peptide
  XENP022843 vlCDR2
FTSYLHS

SEQ ID NO: 35666 - protein, 9 aa, Artificial Sequence
  Description of Artificial Sequence: Synthetic peptide
  XENP022843 vlCDR3
QQGNTLPYT

SEQ ID NO: 35667 - protein, 447 aa, Artificial Sequence; identical to SEQ ID NO: 35647
  Description of Artificial Sequence: Synthetic polypeptide
  XENP022844 2A11_H1.144_L2.113_Fab-[CTLA-4]_H3.23_L0.129_scFv Fab-Fc Heavy Chain

SEQ ID NO: 35668 - protein, 118 aa, Artificial Sequence; identical to SEQ ID NO: 22085
  Description of Artificial Sequence: Synthetic polypeptide
  VH of XENP022844

SEQ ID NO: 35669 - protein, 5 aa, Artificial Sequence
  Description of Artificial Sequence: Synthetic peptide
  XENP022844 vhCDR1
DYFMH

SEQ ID NO: 35670 - protein, 17 aa, Artificial Sequence
  Description of Artificial Sequence: Synthetic peptide
  XENP022844 vhCDR2
WIDPELGDTEYAPKFQG

SEQ ID NO: 35671 - protein, 9 aa, Artificial Sequence
  Description of Artificial Sequence: Synthetic peptide
  XENP022844 vhCDR3
RGVYQALDY

SEQ ID NO: 35672 - protein, 477 aa, Artificial Sequence; identical to SEQ ID NO: 35612
  Description of Artificial Sequence: Synthetic polypeptide
  XENP022844 2A11_H1.144_L2.113_Fab-[CTLA-4]_H3.23_L0.129_scFv scFv-Fc Heavy Chain

SEQ ID NO: 35673 - protein, 118 aa, Artificial Sequence; identical to SEQ ID NO: 2632
  Description of Artificial Sequence: Synthetic polypeptide
  VH of XENP022844

SEQ ID NO: 35674 - protein, 108 aa, Artificial Sequence; identical to SEQ ID NO: 2768
  Description of Artificial Sequence: Synthetic polypeptide
  VL of XENP022844

SEQ ID NO: 35675 - protein, 231 aa, Artificial Sequence; identical to SEQ ID NO: 21572
  Description of Artificial Sequence: Synthetic polypeptide
  Fc chain of XENP022844

SEQ ID NO: 35676 - protein, 5 aa, Artificial Sequence
  Description of Artificial Sequence: Synthetic peptide
  XENP022844 vhCDR1
SYTMH

SEQ ID NO: 35677 - protein, 17 aa, Artificial Sequence
  Description of Artificial Sequence: Synthetic peptide
  XENP022844 vhCDR2
FISYDGNYKYYADSVKG

SEQ ID NO: 35678 - protein, 9 aa, Artificial Sequence
  Description of Artificial Sequence: Synthetic peptide
  XENP022844 vhCDR3
GGHLGPFDL

SEQ ID NO: 35679 - protein, 12 aa, Artificial Sequence
  Description of Artificial Sequence: Synthetic peptide
  XENP022844 vlCDR1
RASQSVGSSYLA

SEQ ID NO: 35680 - protein, 7 aa, Artificial Sequence
  Description of Artificial Sequence: Synthetic peptide
  XENP022844 vlCDR2
GASSRAT

SEQ ID NO: 35681 - protein, 9 aa, Artificial Sequence
  Description of Artificial Sequence: Synthetic peptide
  XENP022844 vlCDR3
QQYGSSPWT

SEQ ID NO: 35682 - protein, 214 aa, Artificial Sequence; identical to SEQ ID NO: 22079
  Description of Artificial Sequence: Synthetic polypeptide
  XENP022844 2A11_H1.144_L2.113_Fab-[CTLA-4]_H3.23_L0.129_scFv Light Chain

SEQ ID NO: 35683 - protein, 107 aa, Artificial Sequence; identical to SEQ ID NO: 22080
  Description of Artificial Sequence: Synthetic polypeptide
  VL of XENP022844

SEQ ID NO: 35684 - protein, 11 aa, Artificial Sequence
  Description of Artificial Sequence: Synthetic peptide
  XENP022844 vlCDR1
QASQDIGNYLN

SEQ ID NO: 35685 - protein, 7 aa, Artificial Sequence
  Description of Artificial Sequence: Synthetic peptide
  XENP022844 vlCDR2
FTSYLHS

SEQ ID NO: 35686 - protein, 9 aa, Artificial Sequence
  Description of Artificial Sequence: Synthetic peptide
  XENP022844 vlCDR3
QQGNTLPYT

SEQ ID NO: 35687 - protein, 447 aa, Artificial Sequence; identical to SEQ ID NO: 21564
  Description of Artificial Sequence: Synthetic polypeptide
  XENP022845 2A11_H1_L2.113_Fab-[CTLA-4]_H3.23_L0.129_scFv Fab -Fc Heavy Chain

SEQ ID NO: 35688 - protein, 118 aa, Artificial Sequence; identical to SEQ ID NO: 17236
  Description of Artificial Sequence: Synthetic polypeptide
  VH of XENP022845

SEQ ID NO: 35689 - protein, 5 aa, Artificial Sequence
  Description of Artificial Sequence: Synthetic peptide
  XENP022845 vhCDR1
DYYMH

SEQ ID NO: 35690 - protein, 17 aa, Artificial Sequence
  Description of Artificial Sequence: Synthetic peptide
  XENP022845 vhCDR2
WIDPENGDTEYAPKFQG

SEQ ID NO: 35691 - protein, 9 aa, Artificial Sequence
  Description of Artificial Sequence: Synthetic peptide
  XENP022845 vhCDR3
RGVRQALDY

SEQ ID NO: 35692 - protein, 477 aa, Artificial Sequence; identical to SEQ ID NO: 35612
  Description of Artificial Sequence: Synthetic polypeptide
  XENP022845 2A11_H1_L2.113_Fab-[CTLA-4]_H3.23_L0.129_scFv scFv -Fc Heavy Chain

SEQ ID NO: 35693 - protein, 118 aa, Artificial Sequence; identical to SEQ ID NO: 2632
  Description of Artificial Sequence: Synthetic polypeptide
  VH of XENP022845

SEQ ID NO: 35694 - protein, 108 aa, Artificial Sequence; identical to SEQ ID NO: 2768
  Description of Artificial Sequence: Synthetic polypeptide
  VL of XENP022845

SEQ ID NO: 35695 - protein, 231 aa, Artificial Sequence; identical to SEQ ID NO: 21572
  Description of Artificial Sequence: Synthetic polypeptide
  Fc chain of XENP022845

SEQ ID NO: 35696 - protein, 5 aa, Artificial Sequence
  Description of Artificial Sequence: Synthetic peptide
  XENP022845 vhCDR1
SYTMH

SEQ ID NO: 35697 - protein, 17 aa, Artificial Sequence
  Description of Artificial Sequence: Synthetic peptide
  XENP022845 vhCDR2
FISYDGNYKYYADSVKG

SEQ ID NO: 35698 - protein, 9 aa, Artificial Sequence
  Description of Artificial Sequence: Synthetic peptide
  XENP022845 vhCDR3
GGHLGPFDL

SEQ ID NO: 35699 - protein, 12 aa, Artificial Sequence
  Description of Artificial Sequence: Synthetic peptide
  XENP022845 vlCDR1
RASQSVGSSYLA

SEQ ID NO: 35700 - protein, 7 aa, Artificial Sequence
  Description of Artificial Sequence: Synthetic peptide
  XENP022845 vlCDR2
GASSRAT

SEQ ID NO: 35701 - protein, 9 aa, Artificial Sequence
  Description of Artificial Sequence: Synthetic peptide
  XENP022845 vlCDR3
QQYGSSPWT

SEQ ID NO: 35702 - protein, 214 aa, Artificial Sequence; identical to SEQ ID NO: 22079
  Description of Artificial Sequence: Synthetic polypeptide
  XENP022845 2A11_H1_L2.113_Fab-[CTLA-4]_H3.23_L0.129_scFv Light Chain

SEQ ID NO: 35703 - protein, 107 aa, Artificial Sequence; identical to SEQ ID NO: 22080
  Description of Artificial Sequence: Synthetic polypeptide
  VL of XENP022845

SEQ ID NO: 35704 - protein, 11 aa, Artificial Sequence
  Description of Artificial Sequence: Synthetic peptide
  XENP022845 vlCDR1
QASQDIGNYLN

SEQ ID NO: 35705 - protein, 7 aa, Artificial Sequence
  Description of Artificial Sequence: Synthetic peptide
  XENP022845 vlCDR2
FTSYLHS

SEQ ID NO: 35706 - protein, 9 aa, Artificial Sequence
  Description of Artificial Sequence: Synthetic peptide
  XENP022845 vlCDR3
QQGNTLPYT

SEQ ID NO: 35707 - protein, 447 aa, Artificial Sequence
  Description of Artificial Sequence: Synthetic polypeptide
  XENP022846 2A11_H1.125_L2.126_Fab-[CTLA-4]_H3.23_L0.129_scFv Fab-Fc Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 35708 - protein, 118 aa, Artificial Sequence; identical to SEQ ID NO: 22065
  Description of Artificial Sequence: Synthetic polypeptide
  VH of XENP022846

SEQ ID NO: 35709 - protein, 5 aa, Artificial Sequence
  Description of Artificial Sequence: Synthetic peptide
  XENP022846 vhCDR1
HYFMH

SEQ ID NO: 35710 - protein, 17 aa, Artificial Sequence
  Description of Artificial Sequence: Synthetic peptide
  XENP022846 vhCDR2
WIDPYLGDTEYAPKFQG

SEQ ID NO: 35711 - protein, 9 aa, Artificial Sequence
  Description of Artificial Sequence: Synthetic peptide
  XENP022846 vhCDR3
RGVYQALDY

SEQ ID NO: 35712 - protein, 477 aa, Artificial Sequence; identical to SEQ ID NO: 35612
  Description of Artificial Sequence: Synthetic polypeptide
  XENP022846 2A11_H1.125_L2.126_Fab-[CTLA-4]_H3.23_L0.129_scFv scFv-Fc Heavy Chain

SEQ ID NO: 35713 - protein, 118 aa, Artificial Sequence; identical to SEQ ID NO: 2632
  Description of Artificial Sequence: Synthetic polypeptide
  VH of XENP022846

SEQ ID NO: 35714 - protein, 108 aa, Artificial Sequence; identical to SEQ ID NO: 2768
  Description of Artificial Sequence: Synthetic polypeptide
  VL of XENP022846

SEQ ID NO: 35715 - protein, 231 aa, Artificial Sequence; identical to SEQ ID NO: 21572
  Description of Artificial Sequence: Synthetic polypeptide
  Fc chain of XENP022846

SEQ ID NO: 35716 - protein, 5 aa, Artificial Sequence
  Description of Artificial Sequence: Synthetic peptide
  XENP022846 vhCDR1
SYTMH

SEQ ID NO: 35717 - protein, 17 aa, Artificial Sequence
  Description of Artificial Sequence: Synthetic peptide
  XENP022846 vhCDR2
FISYDGNYKYYADSVKG

SEQ ID NO: 35718 - protein, 9 aa, Artificial Sequence
  Description of Artificial Sequence: Synthetic peptide
  XENP022846 vhCDR3
GGHLGPFDL

SEQ ID NO: 35719 - protein, 12 aa, Artificial Sequence
  Description of Artificial Sequence: Synthetic peptide
  XENP022846 vlCDR1
RASQSVGSSYLA

SEQ ID NO: 35720 - protein, 7 aa, Artificial Sequence
  Description of Artificial Sequence: Synthetic peptide
  XENP022846 vlCDR2
GASSRAT

SEQ ID NO: 35721 - protein, 9 aa, Artificial Sequence
  Description of Artificial Sequence: Synthetic peptide
  XENP022846 vlCDR3
QQYGSSPWT

SEQ ID NO: 35722 - protein, 214 aa, Artificial Sequence; identical to SEQ ID NO: 22259
  Description of Artificial Sequence: Synthetic polypeptide
  XENP022846 2A11_H1.125_L2.126_Fab-[CTLA-4]_H3.23_L0.129_scFv Light Chain

SEQ ID NO: 35723 - protein, 107 aa, Artificial Sequence; identical to SEQ ID NO: 22260
  Description of Artificial Sequence: Synthetic polypeptide
  VL of XENP022846

SEQ ID NO: 35724 - protein, 11 aa, Artificial Sequence
  Description of Artificial Sequence: Synthetic peptide
  XENP022846 vlCDR1
QASQDIGNYLN

SEQ ID NO: 35725 - protein, 7 aa, Artificial Sequence
  Description of Artificial Sequence: Synthetic peptide
  XENP022846 vlCDR2
FTSYLHS

SEQ ID NO: 35726 - protein, 9 aa, Artificial Sequence
  Description of Artificial Sequence: Synthetic peptide
  XENP022846 vlCDR3
QEGNTLPYT

SEQ ID NO: 35727 - protein, 450 aa, Artificial Sequence
  Description of Artificial Sequence: Synthetic polypeptide
  XENP023223 7G8_H3.66_L1.34_Fab-[CTLA-4]_H3.23_L0.129_scFv Fab -Fc Heavy Chain
EVQLVESGGGLVQPGGSLRLSCAASGFTFDEAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35728 - protein, 121 aa, Artificial Sequence; identical to SEQ ID NO: 35418
  Description of Artificial Sequence: Synthetic polypeptide
  VH of XENP023223

SEQ ID NO: 35729 - protein, 5 aa, Artificial Sequence
  Description of Artificial Sequence: Synthetic peptide
  XENP023223 vhCDR1
EAWMS

SEQ ID NO: 35730 - protein, 19 aa, Artificial Sequence
  Description of Artificial Sequence: Synthetic peptide
  XENP023223 vhCDR2
EISTKANNHATYYAESVKG

SEQ ID NO: 35731 - protein, 10 aa, Artificial Sequence
  Description of Artificial Sequence: Synthetic peptide
  XENP023223 vhCDR3
LATWDWYFDV

SEQ ID NO: 35732 - protein, 477 aa, Artificial Sequence; identical to SEQ ID NO: 21669
  Description of Artificial Sequence: Synthetic polypeptide
  XENP023223 7G8_H3.66_L1.34_Fab-[CTLA-4]_H3.23_L0.129_scFv scFv -Fc Heavy Chain

SEQ ID NO: 35733 - protein, 118 aa, Artificial Sequence; identical to SEQ ID NO: 2632
  Description of Artificial Sequence: Synthetic polypeptide
  VH of XENP023223

SEQ ID NO: 35734 - protein, 108 aa, Artificial Sequence; identical to SEQ ID NO: 2768
  Description of Artificial Sequence: Synthetic polypeptide
  VL of XENP023223

SEQ ID NO: 35735 - protein, 231 aa, Artificial Sequence; identical to SEQ ID NO: 21532
  Description of Artificial Sequence: Synthetic polypeptide
  Fc chain of XENP023223

SEQ ID NO: 35736 - protein, 5 aa, Artificial Sequence
  Description of Artificial Sequence: Synthetic peptide
  XENP023223 vhCDR1
SYTMH

SEQ ID NO: 35737 - protein, 17 aa, Artificial Sequence
  Description of Artificial Sequence: Synthetic peptide
  XENP023223 vhCDR2
FISYDGNYKYYADSVKG

SEQ ID NO: 35738 - protein, 9 aa, Artificial Sequence
  Description of Artificial Sequence: Synthetic peptide
  XENP023223 vhCDR3
GGHLGPFDL

SEQ ID NO: 35739 - protein, 12 aa, Artificial Sequence
  Description of Artificial Sequence: Synthetic peptide
  XENP023223 vlCDR1
RASQSVGSSYLA

SEQ ID NO: 35740 - protein, 7 aa, Artificial Sequence
  Description of Artificial Sequence: Synthetic peptide
  XENP023223 vlCDR2
GASSRAT

SEQ ID NO: 35741 - protein, 9 aa, Artificial Sequence
  Description of Artificial Sequence: Synthetic peptide
  XENP023223 vlCDR3
QQYGSSPWT

SEQ ID NO: 35742 - protein, 218 aa, Artificial Sequence; identical to SEQ ID NO: 22599
  Description of Artificial Sequence: Synthetic polypeptide
  XENP023223 7G8_H3.66_L1.34_Fab-[CTLA-4]_H3.23_L0.129_scFv Light Chain

SEQ ID NO: 35743 - protein, 111 aa, Artificial Sequence; identical to SEQ ID NO: 22600
  Description of Artificial Sequence: Synthetic polypeptide
  VL of XENP023223

SEQ ID NO: 35744 - protein, 15 aa, Artificial Sequence
  Description of Artificial Sequence: Synthetic peptide
  XENP023223 vlCDR1
RASQSVDYDGDSYMN

SEQ ID NO: 35745 - protein, 7 aa, Artificial Sequence
  Description of Artificial Sequence: Synthetic peptide
  XENP023223 vlCDR2
AASELES

SEQ ID NO: 35746 - protein, 9 aa, Artificial Sequence
  Description of Artificial Sequence: Synthetic peptide
  XENP023223 vlCDR3
QQSNEDPFT

SEQ ID NO: 35747 - protein, 450 aa, Artificial Sequence
  Description of Artificial Sequence: Synthetic polypeptide
  XENP023224 7G8_H3.67_L1.34_Fab-[CTLA-4]_H3.23_L0.129_scFv Fab -Fc Heavy Chain
EVQLVESGGGLVQPGGSLRLSCAASGFTFDDTWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35748 - protein, 121 aa, Artificial Sequence; identical to SEQ ID NO: 35428
  Description of Artificial Sequence: Synthetic polypeptide
  VH of XENP023224

SEQ ID NO: 35749 - protein, 5 aa, Artificial Sequence
  Description of Artificial Sequence: Synthetic peptide
  XENP023224 vhCDR1
DTWMS

SEQ ID NO: 35750 - protein, 19 aa, Artificial Sequence
  Description of Artificial Sequence: Synthetic peptide
  XENP023224 vhCDR2
EISTKANNHATYYAESVKG

SEQ ID NO: 35751 - protein, 10 aa, Artificial Sequence
  Description of Artificial Sequence: Synthetic peptide
  XENP023224 vhCDR3
LATWDWYFDV

SEQ ID NO: 35752 - protein, 477 aa, Artificial Sequence; identical to SEQ ID NO: 21669
  Description of Artificial Sequence: Synthetic polypeptide
  XENP023224 7G8_H3.67_L1.34_Fab-[CTLA-4]_H3.23_L0.129_scFv scFv -Fc Heavy Chain

SEQ ID NO: 35753 - protein, 118 aa, Artificial Sequence; identical to SEQ ID NO: 2632
  Description of Artificial Sequence: Synthetic polypeptide
  VH of XENP023224

SEQ ID NO: 35754 - protein, 108 aa, Artificial Sequence; identical to SEQ ID NO: 2768
  Description of Artificial Sequence: Synthetic polypeptide
  VL of XENP023224

SEQ ID NO: 35755 - protein, 231 aa, Artificial Sequence; identical to SEQ ID NO: 21532
  Description of Artificial Sequence: Synthetic polypeptide
  Fc chain of XENP023224

SEQ ID NO: 35756 - protein, 5 aa, Artificial Sequence
  Description of Artificial Sequence: Synthetic peptide
  XENP023224 vhCDR1
SYTMH

SEQ ID NO: 35757 - protein, 17 aa, Artificial Sequence
  Description of Artificial Sequence: Synthetic peptide
  XENP023224 vhCDR2
FISYDGNYKYYADSVKG

SEQ ID NO: 35758 - protein, 9 aa, Artificial Sequence
  Description of Artificial Sequence: Synthetic peptide
  XENP023224 vhCDR3
GGHLGPFDL

SEQ ID NO: 35759 - protein, 12 aa, Artificial Sequence
  Description of Artificial Sequence: Synthetic peptide
  XENP023224 vlCDR1
RASQSVGSSYLA

SEQ ID NO: 35760 - protein, 7 aa, Artificial Sequence
  Description of Artificial Sequence: Synthetic peptide
  XENP023224 vlCDR2
GASSRAT

SEQ ID NO: 35761 - protein, 9 aa, Artificial Sequence
  Description of Artificial Sequence: Synthetic peptide
  XENP023224 vlCDR3
QQYGSSPWT

SEQ ID NO: 35762 - protein, 218 aa, Artificial Sequence; identical to SEQ ID NO: 22599
  Description of Artificial Sequence: Synthetic polypeptide
  XENP023224 7G8_H3.67_L1.34_Fab-[CTLA-4]_H3.23_L0.129_scFv Light Chain

SEQ ID NO: 35763 - protein, 111 aa, Artificial Sequence; identical to SEQ ID NO: 22600
  Description of Artificial Sequence: Synthetic polypeptide
  VL of XENP023224

SEQ ID NO: 35764 - protein, 15 aa, Artificial Sequence
  Description of Artificial Sequence: Synthetic peptide
  XENP023224 vlCDR1
RASQSVDYDGDSYMN

SEQ ID NO: 35765 - protein, 7 aa, Artificial Sequence
  Description of Artificial Sequence: Synthetic peptide
  XENP023224 vlCDR2
AASELES

SEQ ID NO: 35766 - protein, 9 aa, Artificial Sequence
  Description of Artificial Sequence: Synthetic peptide
  XENP023224 vlCDR3
QQSNEDPFT

SEQ ID NO: 35767 - protein, 450 aa, Artificial Sequence
  Description of Artificial Sequence: Synthetic polypeptide
  XENP023225 7G8_H3.71_L1.34_Fab-[CTLA-4]_H3.23_L0.129_scFv Fab-Fc Heavy Chain
EVQLVESGGGLVQPGGSLRLSCAASGFTFDDAWMSWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35768 - protein, 121 aa, Artificial Sequence; identical to SEQ ID NO: 35468
  Description of Artificial Sequence: Synthetic polypeptide
  VH of XENP023225

SEQ ID NO: 35769 - protein, 5 aa, Artificial Sequence
  Description of Artificial Sequence: Synthetic peptide
  XENP023225 vhCDR1
DAWMS

SEQ ID NO: 35770 - protein, 19 aa, Artificial Sequence
  Description of Artificial Sequence: Synthetic peptide
  XENP023225 vhCDR2
EISTKAYNHATYYAESVKG

SEQ ID NO: 35771 - protein, 10 aa, Artificial Sequence
  Description of Artificial Sequence: Synthetic peptide
  XENP023225 vhCDR3
LATWDWYFDV

SEQ ID NO: 35772 - protein, 477 aa, Artificial Sequence; identical to SEQ ID NO: 21669
  Description of Artificial Sequence: Synthetic polypeptide
  XENP023225 7G8_H3.71_L1.34_Fab-[CTLA-4]_H3.23_L0.129_scFv scFv -Fc Heavy Chain

SEQ ID NO: 35773 - protein, 118 aa, Artificial Sequence; identical to SEQ ID NO: 2632
  Description of Artificial Sequence: Synthetic polypeptide
  VH of XENP023225

SEQ ID NO: 35774 - protein, 108 aa, Artificial Sequence; identical to SEQ ID NO: 2768
  Description of Artificial Sequence: Synthetic polypeptide
  VL of XENP023225

SEQ ID NO: 35775 - protein, 231 aa, Artificial Sequence; identical to SEQ ID NO: 21532
  Description of Artificial Sequence: Synthetic polypeptide
  Fc chain of XENP023225

SEQ ID NO: 35776 - protein, 5 aa, Artificial Sequence
  Description of Artificial Sequence: Synthetic peptide
  XENP023225 vhCDR1
SYTMH

SEQ ID NO: 35777 - protein, 17 aa, Artificial Sequence
  Description of Artificial Sequence: Synthetic peptide
  XENP023225 vhCDR2
FISYDGNYKYYADSVKG

SEQ ID NO: 35778 - protein, 9 aa, Artificial Sequence
  Description of Artificial Sequence: Synthetic peptide
  XENP023225 vhCDR3
GGHLGPFDL

SEQ ID NO: 35779 - protein, 12 aa, Artificial Sequence
  Description of Artificial Sequence: Synthetic peptide
  XENP023225 vlCDR1
RASQSVGSSYLA

SEQ ID NO: 35780 - protein, 7 aa, Artificial Sequence
  Description of Artificial Sequence: Synthetic peptide
  XENP023225 vlCDR2
GASSRAT

SEQ ID NO: 35781 - protein, 9 aa, Artificial Sequence
  Description of Artificial Sequence: Synthetic peptide
  XENP023225 vlCDR3
QQYGSSPWT

SEQ ID NO: 35782 - protein, 218 aa, Artificial Sequence; identical to SEQ ID NO: 22599
  Description of Artificial Sequence: Synthetic polypeptide
  XENP023225 7G8_H3.71_L1.34_Fab-[CTLA-4]_H3.23_L0.129_scFv Light Chain

SEQ ID NO: 35783 - protein, 111 aa, Artificial Sequence; identical to SEQ ID NO: 22600
  Description of Artificial Sequence: Synthetic polypeptide
  VL of XENP023225

SEQ ID NO: 35784 - protein, 15 aa, Artificial Sequence
  Description of Artificial Sequence: Synthetic peptide
  XENP023225 vlCDR1
RASQSVDYDGDSYMN

SEQ ID NO: 35785 - protein, 7 aa, Artificial Sequence
  Description of Artificial Sequence: Synthetic peptide
  XENP023225 vlCDR2
AASELES

SEQ ID NO: 35786 - protein, 9 aa, Artificial Sequence
  Description of Artificial Sequence: Synthetic peptide
  XENP023225 vlCDR3
QQSNEDPFT

SEQ ID NO: 35787 - protein, 450 aa, Artificial Sequence; identical to SEQ ID NO: 22484
  Description of Artificial Sequence: Synthetic polypeptide
  XENP023226 7G8_H3.30_L1.39_Fab-[CTLA-4]_H3.23_L0.129_scFv Fab- Fc Heavy Chain

SEQ ID NO: 35788 - protein, 121 aa, Artificial Sequence; identical to SEQ ID NO: 22485
  Description of Artificial Sequence: Synthetic polypeptide
  VH of XENP023226

SEQ ID NO: 35789 - protein, 5 aa, Artificial Sequence
  Description of Artificial Sequence: Synthetic peptide
  XENP023226 vhCDR1
DAWMS

SEQ ID NO: 35790 - protein, 19 aa, Artificial Sequence
  Description of Artificial Sequence: Synthetic peptide
  XENP023226 vhCDR2
EISTKANNHATYYAESVKG

SEQ ID NO: 35791 - protein, 10 aa, Artificial Sequence
  Description of Artificial Sequence: Synthetic peptide
  XENP023226 vhCDR3
LATWDWYFDV

SEQ ID NO: 35792 - protein, 477 aa, Artificial Sequence; identical to SEQ ID NO: 21669
  Description of Artificial Sequence: Synthetic polypeptide
  XENP023226 7G8_H3.30_L1.39_Fab-[CTLA-4]_H3.23_L0.129_scFv scFv -Fc Heavy Chain

SEQ ID NO: 35793 - protein, 118 aa, Artificial Sequence; identical to SEQ ID NO: 2632
  Description of Artificial Sequence: Synthetic polypeptide
  VH of XENP023226

SEQ ID NO: 35794 - protein, 108 aa, Artificial Sequence; identical to SEQ ID NO: 2768
  Description of Artificial Sequence: Synthetic polypeptide
  VL of XENP023226

SEQ ID NO: 35795 - protein, 231 aa, Artificial Sequence; identical to SEQ ID NO: 21532
  Description of Artificial Sequence: Synthetic polypeptide
  Fc chain of XENP023226

SEQ ID NO: 35796 - protein, 5 aa, Artificial Sequence
  Description of Artificial Sequence: Synthetic peptide
  XENP023226 vhCDR1
SYTMH

SEQ ID NO: 35797 - protein, 17 aa, Artificial Sequence
  Description of Artificial Sequence: Synthetic peptide
  XENP023226 vhCDR2
FISYDGNYKYYADSVKG

SEQ ID NO: 35798 - protein, 9 aa, Artificial Sequence
  Description of Artificial Sequence: Synthetic peptide
  XENP023226 vhCDR3
GGHLGPFDL

SEQ ID NO: 35799 - protein, 12 aa, Artificial Sequence
  Description of Artificial Sequence: Synthetic peptide
  XENP023226 vlCDR1
RASQSVGSSYLA

SEQ ID NO: 35800 - protein, 7 aa, Artificial Sequence
  Description of Artificial Sequence: Synthetic peptide
  XENP023226 vlCDR2
GASSRAT

SEQ ID NO: 35801 - protein, 9 aa, Artificial Sequence
  Description of Artificial Sequence: Synthetic peptide
  XENP023226 vlCDR3
QQYGSSPWT

SEQ ID NO: 35802 - protein, 218 aa, Artificial Sequence; identical to SEQ ID NO: 35532
  Description of Artificial Sequence: Synthetic polypeptide
  XENP023226 7G8_H3.30_L1.39_Fab-[CTLA-4]_H3.23_L0.129_scFv Light Chain

SEQ ID NO: 35803 - protein, 111 aa, Artificial Sequence; identical to SEQ ID NO: 35533
  Description of Artificial Sequence: Synthetic polypeptide
  VL of XENP023226

SEQ ID NO: 35804 - protein, 15 aa, Artificial Sequence
  Description of Artificial Sequence: Synthetic peptide
  XENP023226 vlCDR1
RASQSVDYYGDSYMN

SEQ ID NO: 35805 - protein, 7 aa, Artificial Sequence
  Description of Artificial Sequence: Synthetic peptide
  XENP023226 vlCDR2
AASELES

SEQ ID NO: 35806 - protein, 9 aa, Artificial Sequence
  Description of Artificial Sequence: Synthetic peptide
  XENP023226 vlCDR3
QQSNEDPFT

SEQ ID NO: 35807 - protein, 450 aa, Artificial Sequence; identical to SEQ ID NO: 35727
  Description of Artificial Sequence: Synthetic polypeptide
  XENP023227 7G8_H3.66_L1.39_Fab-[CTLA-4]_H3.23_L0.129_scFv Fab -Fc Heavy Chain

SEQ ID NO: 35808 - protein, 121 aa, Artificial Sequence; identical to SEQ ID NO: 35418
  Description of Artificial Sequence: Synthetic polypeptide
  VH of XENP023227

SEQ ID NO: 35809 - protein, 5 aa, Artificial Sequence
  Description of Artificial Sequence: Synthetic peptide
  XENP023227 vhCDR1
EAWMS

SEQ ID NO: 35810 - protein, 19 aa, Artificial Sequence
  Description of Artificial Sequence: Synthetic peptide
  XENP023227 vhCDR2
EISTKANNHATYYAESVKG

SEQ ID NO: 35811 - protein, 10 aa, Artificial Sequence
  Description of Artificial Sequence: Synthetic peptide
  XENP023227 vhCDR3
LATWDWYFDV

SEQ ID NO: 35812 - protein, 477 aa, Artificial Sequence; identical to SEQ ID NO: 21669
  Description of Artificial Sequence: Synthetic polypeptide
  XENP023227 7G8_H3.66_L1.39_Fab-[CTLA-4]_H3.23_L0.129_scFv scFv -Fc Heavy Chain

SEQ ID NO: 35813 - protein, 118 aa, Artificial Sequence; identical to SEQ ID NO: 2632
  Description of Artificial Sequence: Synthetic polypeptide
  VH of XENP023227

SEQ ID NO: 35814 - protein, 108 aa, Artificial Sequence; identical to SEQ ID NO: 2768
  Description of Artificial Sequence: Synthetic polypeptide
  VL of XENP023227

SEQ ID NO: 35815 - protein, 231 aa, Artificial Sequence; identical to SEQ ID NO: 21532
  Description of Artificial Sequence: Synthetic polypeptide
  Fc chain of XENP023227

SEQ ID NO: 35816 - protein, 5 aa, Artificial Sequence
  Description of Artificial Sequence: Synthetic peptide
  XENP023227 vhCDR1
SYTMH

SEQ ID NO: 35817 - protein, 17 aa, Artificial Sequence
  Description of Artificial Sequence: Synthetic peptide
  XENP023227 vhCDR2
FISYDGNYKYYADSVKG

SEQ ID NO: 35818 - protein, 9 aa, Artificial Sequence
  Description of Artificial Sequence: Synthetic peptide
  XENP023227 vhCDR3
GGHLGPFDL

SEQ ID NO: 35819 - protein, 12 aa, Artificial Sequence
  Description of Artificial Sequence: Synthetic peptide
  XENP023227 vlCDR1
RASQSVGSSYLA

SEQ ID NO: 35820 - protein, 7 aa, Artificial Sequence
  Description of Artificial Sequence: Synthetic peptide
  XENP023227 vlCDR2
GASSRAT

SEQ ID NO: 35821 - protein, 9 aa, Artificial Sequence
  Description of Artificial Sequence: Synthetic peptide
  XENP023227 vlCDR3
QQYGSSPWT

SEQ ID NO: 35822 - protein, 218 aa, Artificial Sequence; identical to SEQ ID NO: 35532
  Description of Artificial Sequence: Synthetic polypeptide
  XENP023227 7G8_H3.66_L1.39_Fab-[CTLA-4]_H3.23_L0.129_scFv Light Chain

SEQ ID NO: 35823 - protein, 111 aa, Artificial Sequence; identical to SEQ ID NO: 35533
  Description of Artificial Sequence: Synthetic polypeptide
  VL of XENP023227

SEQ ID NO: 35824 - protein, 15 aa, Artificial Sequence
  Description of Artificial Sequence: Synthetic peptide
  XENP023227 vlCDR1
RASQSVDYYGDSYMN

SEQ ID NO: 35825 - protein, 7 aa, Artificial Sequence
  Description of Artificial Sequence: Synthetic peptide
  XENP023227 vlCDR2
AASELES

SEQ ID NO: 35826 - protein, 9 aa, Artificial Sequence
  Description of Artificial Sequence: Synthetic peptide
  XENP023227 vlCDR3
QQSNEDPFT

SEQ ID NO: 35827 - protein, 450 aa, Artificial Sequence; identical to SEQ ID NO: 35747
  Description of Artificial Sequence: Synthetic polypeptide
  XENP023228 7G8_H3.67_L1.39_Fab-[CTLA-4]_H3.23_L0.129_scFv Fab- Fc Heavy Chain

SEQ ID NO: 35828 - protein, 121 aa, Artificial Sequence; identical to SEQ ID NO: 35428
  Description of Artificial Sequence: Synthetic polypeptide
  VH of XENP023228

SEQ ID NO: 35829 - protein, 5 aa, Artificial Sequence
  Description of Artificial Sequence: Synthetic peptide
  XENP023228 vhCDR1
DTWMS

SEQ ID NO: 35830 - protein, 19 aa, Artificial Sequence
  Description of Artificial Sequence: Synthetic peptide
  XENP023228 vhCDR2
EISTKANNHATYYAESVKG

SEQ ID NO: 35831 - protein, 10 aa, Artificial Sequence
  Description of Artificial Sequence: Synthetic peptide
  XENP023228 vhCDR3
LATWDWYFDV

SEQ ID NO: 35832 - protein, 477 aa, Artificial Sequence; identical to SEQ ID NO: 21669
  Description of Artificial Sequence: Synthetic polypeptide
  XENP023228 7G8_H3.67_L1.39_Fab-[CTLA-4]_H3.23_L0.129_scFv scFv -Fc Heavy Chain

SEQ ID NO: 35833 - protein, 118 aa, Artificial Sequence; identical to SEQ ID NO: 2632
  Description of Artificial Sequence: Synthetic polypeptide
  VH of XENP023228

SEQ ID NO: 35834 - protein, 108 aa, Artificial Sequence; identical to SEQ ID NO: 2768
  Description of Artificial Sequence: Synthetic polypeptide
  VL of XENP023228

SEQ ID NO: 35835 - protein, 231 aa, Artificial Sequence; identical to SEQ ID NO: 21532
  Description of Artificial Sequence: Synthetic polypeptide
  Fc chain of XENP023228

SEQ ID NO: 35836 - protein, 5 aa, Artificial Sequence
  Description of Artificial Sequence: Synthetic peptide
  XENP023228 vhCDR1
SYTMH

SEQ ID NO: 35837 - protein, 17 aa, Artificial Sequence
  Description of Artificial Sequence: Synthetic peptide
  XENP023228 vhCDR2
FISYDGNYKYYADSVKG

SEQ ID NO: 35838 - protein, 9 aa, Artificial Sequence
  Description of Artificial Sequence: Synthetic peptide
  XENP023228 vhCDR3
GGHLGPFDL

SEQ ID NO: 35839 - protein, 12 aa, Artificial Sequence
  Description of Artificial Sequence: Synthetic peptide
  XENP023228 vlCDR1
RASQSVGSSYLA

SEQ ID NO: 35840 - protein, 7 aa, Artificial Sequence
  Description of Artificial Sequence: Synthetic peptide
  XENP023228 vlCDR2
GASSRAT

SEQ ID NO: 35841 - protein, 9 aa, Artificial Sequence
  Description of Artificial Sequence: Synthetic peptide
  XENP023228 vlCDR3
QQYGSSPWT

SEQ ID NO: 35842 - protein, 218 aa, Artificial Sequence; identical to SEQ ID NO: 35532
  Description of Artificial Sequence: Synthetic polypeptide
  XENP023228 7G8_H3.67_L1.39_Fab-[CTLA-4]_H3.23_L0.129_scFv Light Chain

SEQ ID NO: 35843 - protein, 111 aa, Artificial Sequence; identical to SEQ ID NO: 35533
  Description of Artificial Sequence: Synthetic polypeptide
  VL of XENP023228

SEQ ID NO: 35844 - protein, 15 aa, Artificial Sequence
  Description of Artificial Sequence: Synthetic peptide
  XENP023228 vlCDR1
RASQSVDYYGDSYMN

SEQ ID NO: 35845 - protein, 7 aa, Artificial Sequence
  Description of Artificial Sequence: Synthetic peptide
  XENP023228 vlCDR2
AASELES

SEQ ID NO: 35846 - protein, 9 aa, Artificial Sequence
  Description of Artificial Sequence: Synthetic peptide
  XENP023228 vlCDR3
QQSNEDPFT

SEQ ID NO: 35847 - protein, 450 aa, Artificial Sequence; identical to SEQ ID NO: 35767
  Description of Artificial Sequence: Synthetic polypeptide
  XENP023229 7G8_H3.71_L1.39_Fab-[CTLA-4]_H3.23_L0.129_scFv Fab -Fc Heavy Chain

SEQ ID NO: 35848 - protein, 121 aa, Artificial Sequence; identical to SEQ ID NO: 35468
  Description of Artificial Sequence: Synthetic polypeptide
  VH of XENP023229

SEQ ID NO: 35849 - protein, 5 aa, Artificial Sequence
  Description of Artificial Sequence: Synthetic peptide
  XENP023229 vhCDR1
DAWMS

SEQ ID NO: 35850 - protein, 19 aa, Artificial Sequence
  Description of Artificial Sequence: Synthetic peptide
  XENP023229 vhCDR2
EISTKAYNHATYYAESVKG

SEQ ID NO: 35851 - protein, 10 aa, Artificial Sequence
  Description of Artificial Sequence: Synthetic peptide
  XENP023229 vhCDR3
LATWDWYFDV

SEQ ID NO: 35852 - protein, 477 aa, Artificial Sequence; identical to SEQ ID NO: 21669
  Description of Artificial Sequence: Synthetic polypeptide
  XENP023229 7G8_H3.71_L1.39_Fab-[CTLA-4]_H3.23_L0.129_scFv scFv -Fc Heavy Chain

SEQ ID NO: 35853 - protein, 118 aa, Artificial Sequence; identical to SEQ ID NO: 2632
  Description of Artificial Sequence: Synthetic polypeptide
  VH of XENP023229

SEQ ID NO: 35854 - protein, 108 aa, Artificial Sequence; identical to SEQ ID NO: 2768
  Description of Artificial Sequence: Synthetic polypeptide
  VL of XENP023229

SEQ ID NO: 35855 - protein, 231 aa, Artificial Sequence; identical to SEQ ID NO: 21532
  Description of Artificial Sequence: Synthetic polypeptide
  Fc chain of XENP023229

SEQ ID NO: 35856 - protein, 5 aa, Artificial Sequence
  Description of Artificial Sequence: Synthetic peptide
  XENP023229 vhCDR1
SYTMH

SEQ ID NO: 35857 - protein, 17 aa, Artificial Sequence
  Description of Artificial Sequence: Synthetic peptide
  XENP023229 vhCDR2
FISYDGNYKYYADSVKG

SEQ ID NO: 35858 - protein, 9 aa, Artificial Sequence
  Description of Artificial Sequence: Synthetic peptide
  XENP023229 vhCDR3
GGHLGPFDL

SEQ ID NO: 35859 - protein, 12 aa, Artificial Sequence
  Description of Artificial Sequence: Synthetic peptide
  XENP023229 vlCDR1
RASQSVGSSYLA

SEQ ID NO: 35860 - protein, 7 aa, Artificial Sequence
  Description of Artificial Sequence: Synthetic peptide
  XENP023229 vlCDR2
GASSRAT

SEQ ID NO: 35861 - protein, 9 aa, Artificial Sequence
  Description of Artificial Sequence: Synthetic peptide
  XENP023229 vlCDR3
QQYGSSPWT

SEQ ID NO: 35862 - protein, 218 aa, Artificial Sequence; identical to SEQ ID NO: 35532
  Description of Artificial Sequence: Synthetic polypeptide
  XENP023229 7G8_H3.71_L1.39_Fab-[CTLA-4]_H3.23_L0.129_scFv Light Chain

SEQ ID NO: 35863 - protein, 111 aa, Artificial Sequence; identical to SEQ ID NO: 35533
  Description of Artificial Sequence: Synthetic polypeptide
  VL of XENP023229

SEQ ID NO: 35864 - protein, 15 aa, Artificial Sequence
  Description of Artificial Sequence: Synthetic peptide
  XENP023229 vlCDR1
RASQSVDYYGDSYMN

SEQ ID NO: 35865 - protein, 7 aa, Artificial Sequence
  Description of Artificial Sequence: Synthetic peptide
  XENP023229 vlCDR2
AASELES

SEQ ID NO: 35866 - protein, 9 aa, Artificial Sequence
  Description of Artificial Sequence: Synthetic peptide
  XENP023229 vlCDR3
QQSNEDPFT

SEQ ID NO: 35867 - protein, 447 aa, Artificial Sequence; identical to SEQ ID NO: 22084
  Description of Artificial Sequence: Synthetic polypeptide
  XENP022718 2A11_H1.144_L2_Fab-1G6_L1.194_H1.279_scFv Fab-Fc Heavy Chain

SEQ ID NO: 35868 - protein, 118 aa, Artificial Sequence; identical to SEQ ID NO: 22085
  Description of Artificial Sequence: Synthetic polypeptide
  VH of XENP022718

SEQ ID NO: 35869 - protein, 5 aa, Artificial Sequence
  Description of Artificial Sequence: Synthetic peptide
  XENP022718 vhCDR1
DYFMH

SEQ ID NO: 35870 - protein, 17 aa, Artificial Sequence
  Description of Artificial Sequence: Synthetic peptide
  XENP022718 vhCDR2
WIDPELGDTEYAPKFQG

SEQ ID NO: 35871 - protein, 9 aa, Artificial Sequence
  Description of Artificial Sequence: Synthetic peptide
  XENP022718 vhCDR3
RGVYQALDY

SEQ ID NO: 35872 - protein, 480 aa, Artificial Sequence; identical to SEQ ID NO: 23221
  Description of Artificial Sequence: Synthetic polypeptide
  XENP022718 2A11_H1.144_L2_Fab-1G6_L1.194_H1.279_scFv scFv-Fc Heavy Chain

SEQ ID NO: 35873 - protein, 107 aa, Artificial Sequence; identical to SEQ ID NO: 10999
  Description of Artificial Sequence: Synthetic polypeptide
  VH of XENP022718

SEQ ID NO: 35874 - protein, 122 aa, Artificial Sequence; identical to SEQ ID NO: 10908
  Description of Artificial Sequence: Synthetic polypeptide
  VL of XENP022718

SEQ ID NO: 35875 - protein, 231 aa, Artificial Sequence; identical to SEQ ID NO: 21532
  Description of Artificial Sequence: Synthetic polypeptide
  Fc chain of XENP022718

SEQ ID NO: 35876 - protein, 11 aa, Artificial Sequence
  Description of Artificial Sequence: Synthetic peptide
  XENP022718 vhCDR1
RASQSVGNDVA

SEQ ID NO: 35877 - protein, 7 aa, Artificial Sequence
  Description of Artificial Sequence: Synthetic peptide
  XENP022718 vhCDR2
YASHRYT

SEQ ID NO: 35878 - protein, 9 aa, Artificial Sequence
  Description of Artificial Sequence: Synthetic peptide
  XENP022718 vhCDR3
QQDFSSPRT

SEQ ID NO: 35879 - protein, 5 aa, Artificial Sequence
  Description of Artificial Sequence: Synthetic peptide
  XENP022718 vlCDR1
NYWMN

SEQ ID NO: 35880 - protein, 19 aa, Artificial Sequence
  Description of Artificial Sequence: Synthetic peptide
  XENP022718 vlCDR2
EIRLYSNNYATHYAESVKG

SEQ ID NO: 35881 - protein, 11 aa, Artificial Sequence
  Description of Artificial Sequence: Synthetic peptide
  XENP022718 vlCDR3
YYGNYGGYFDV

SEQ ID NO: 35882 - protein, 214 aa, Artificial Sequence; identical to SEQ ID NO: 17250
  Description of Artificial Sequence: Synthetic polypeptide
  XENP022718 2A11_H1.144_L2_Fab-1G6_L1.194_H1.279_scFv Light Chain

SEQ ID NO: 35883 - protein, 107 aa, Artificial Sequence; identical to SEQ ID NO: 17251
  Description of Artificial Sequence: Synthetic polypeptide
  VL of XENP022718

SEQ ID NO: 35884 - protein, 11 aa, Artificial Sequence
  Description of Artificial Sequence: Synthetic peptide
  XENP022718 vlCDR1
QASQDIGNYLN

SEQ ID NO: 35885 - protein, 7 aa, Artificial Sequence
  Description of Artificial Sequence: Synthetic peptide
  XENP022718 vlCDR2
YTSRLHS

SEQ ID NO: 35886 - protein, 9 aa, Artificial Sequence
  Description of Artificial Sequence: Synthetic peptide
  XENP022718 vlCDR3
QQGNTLPYT

SEQ ID NO: 35887 - protein, 447 aa, Artificial Sequence; identical to SEQ ID NO: 17235
  Description of Artificial Sequence: Synthetic polypeptide
  XENP022719 2A11_H1_L2.50_Fab-1G6_L1.194_H1.279_scFv Fab-Fc Heavy Chain

SEQ ID NO: 35888 - protein, 118 aa, Artificial Sequence; identical to SEQ ID NO: 17236
  Description of Artificial Sequence: Synthetic polypeptide
  VH of XENP022719

SEQ ID NO: 35889 - protein, 5 aa, Artificial Sequence
  Description of Artificial Sequence: Synthetic peptide
  XENP022719 vhCDR1
DYYMH

SEQ ID NO: 35890 - protein, 17 aa, Artificial Sequence
  Description of Artificial Sequence: Synthetic peptide
  XENP022719 vhCDR2
WIDPENGDTEYAPKFQG

SEQ ID NO: 35891 - protein, 9 aa, Artificial Sequence
  Description of Artificial Sequence: Synthetic peptide
  XENP022719 vhCDR3
RGVRQALDY

SEQ ID NO: 35892 - protein, 480 aa, Artificial Sequence; identical to SEQ ID NO: 23221
  Description of Artificial Sequence: Synthetic polypeptide
  XENP022719 2A11_H1_L2.50_Fab-1G6_L1.194_H1.279_scFv scFv-Fc Heavy Chain

SEQ ID NO: 35893 - protein, 107 aa, Artificial Sequence; identical to SEQ ID NO: 10999
  Description of Artificial Sequence: Synthetic polypeptide
  VH of XENP022719

SEQ ID NO: 35894 - protein, 122 aa, Artificial Sequence; identical to SEQ ID NO: 10908
  Description of Artificial Sequence: Synthetic polypeptide
  VL of XENP022719

SEQ ID NO: 35895 - protein, 231 aa, Artificial Sequence; identical to SEQ ID NO: 21532
  Description of Artificial Sequence: Synthetic polypeptide
  Fc chain of XENP022719

SEQ ID NO: 35896 - protein, 11 aa, Artificial Sequence
  Description of Artificial Sequence: Synthetic peptide
  XENP022719 vhCDR1
RASQSVGNDVA

SEQ ID NO: 35897 - protein, 7 aa, Artificial Sequence
  Description of Artificial Sequence: Synthetic peptide
  XENP022719 vhCDR2
YASHRYT

SEQ ID NO: 35898 - protein, 9 aa, Artificial Sequence
  Description of Artificial Sequence: Synthetic peptide
  XENP022719 vhCDR3
QQDFSSPRT

SEQ ID NO: 35899 - protein, 5 aa, Artificial Sequence
  Description of Artificial Sequence: Synthetic peptide
  XENP022719 vlCDR1
NYWMN

SEQ ID NO: 35900 - protein, 19 aa, Artificial Sequence
  Description of Artificial Sequence: Synthetic peptide
  XENP022719 vlCDR2
EIRLYSNNYATHYAESVKG

SEQ ID NO: 35901 - protein, 11 aa, Artificial Sequence
  Description of Artificial Sequence: Synthetic peptide
  XENP022719 vlCDR3
YYGNYGGYFDV

SEQ ID NO: 35902 - protein, 214 aa, Artificial Sequence; identical to SEQ ID NO: 22059
  Description of Artificial Sequence: Synthetic polypeptide
  XENP022719 2A11_H1_L2.50_Fab-1G6_L1.194_H1.279_scFv Light Chain

SEQ ID NO: 35903 - protein, 107 aa, Artificial Sequence; identical to SEQ ID NO: 22060
  Description of Artificial Sequence: Synthetic polypeptide
  VL of XENP022719

SEQ ID NO: 35904 - protein, 11 aa, Artificial Sequence
  Description of Artificial Sequence: Synthetic peptide
  XENP022719 vlCDR1
QASQDIGNYLN

SEQ ID NO: 35905 - protein, 7 aa, Artificial Sequence
  Description of Artificial Sequence: Synthetic peptide
  XENP022719 vlCDR2
YTSYLHS

SEQ ID NO: 35906 - protein, 9 aa, Artificial Sequence
  Description of Artificial Sequence: Synthetic peptide
  XENP022719 vlCDR3
QQGNTLPYT

SEQ ID NO: 35907 - protein, 447 aa, Artificial Sequence; identical to SEQ ID NO: 17235
  Description of Artificial Sequence: Synthetic polypeptide
  XENP022720 2A11_H1_L2.113_Fab-1G6_L1.194_H1.279_scFv Fab-Fc Heavy Chain

SEQ ID NO: 35908 - protein, 118 aa, Artificial Sequence; identical to SEQ ID NO: 17236
  Description of Artificial Sequence: Synthetic polypeptide
  VH of XENP022720

SEQ ID NO: 35909 - protein, 5 aa, Artificial Sequence
  Description of Artificial Sequence: Synthetic peptide
  XENP022720 vhCDR1
DYYMH

SEQ ID NO: 35910 - protein, 17 aa, Artificial Sequence
  Description of Artificial Sequence: Synthetic peptide
  XENP022720 vhCDR2
WIDPENGDTEYAPKFQG

SEQ ID NO: 35911 - protein, 9 aa, Artificial Sequence
  Description of Artificial Sequence: Synthetic peptide
  XENP022720 vhCDR3
RGVRQALDY

SEQ ID NO: 35912 - protein, 480 aa, Artificial Sequence; identical to SEQ ID NO: 23221
  Description of Artificial Sequence: Synthetic polypeptide
  XENP022720 2A11_H1_L2.113_Fab-1G6_L1.194_H1.279_scFv scFv-Fc Heavy Chain

SEQ ID NO: 35913 - protein, 107 aa, Artificial Sequence; identical to SEQ ID NO: 10999
  Description of Artificial Sequence: Synthetic polypeptide
  VH of XENP022720

SEQ ID NO: 35914 - protein, 122 aa, Artificial Sequence; identical to SEQ ID NO: 10908
  Description of Artificial Sequence: Synthetic polypeptide
  VL of XENP022720

SEQ ID NO: 35915 - protein, 231 aa, Artificial Sequence; identical to SEQ ID NO: 21532
  Description of Artificial Sequence: Synthetic polypeptide
  Fc chain of XENP022720

SEQ ID NO: 35916 - protein, 11 aa, Artificial Sequence
  Description of Artificial Sequence: Synthetic peptide
  XENP022720 vhCDR1
RASQSVGNDVA

SEQ ID NO: 35917 - protein, 7 aa, Artificial Sequence
  Description of Artificial Sequence: Synthetic peptide
  XENP022720 vhCDR2
YASHRYT

SEQ ID NO: 35918 - protein, 9 aa, Artificial Sequence
  Description of Artificial Sequence: Synthetic peptide
  XENP022720 vhCDR3
QQDFSSPRT

SEQ ID NO: 35919 - protein, 5 aa, Artificial Sequence
  Description of Artificial Sequence: Synthetic peptide
  XENP022720 vlCDR1
NYWMN

SEQ ID NO: 35920 - protein, 19 aa, Artificial Sequence
  Description of Artificial Sequence: Synthetic peptide
  XENP022720 vlCDR2
EIRLYSNNYATHYAESVKG

SEQ ID NO: 35921 - protein, 11 aa, Artificial Sequence
  Description of Artificial Sequence: Synthetic peptide
  XENP022720 vlCDR3
YYGNYGGYFDV

SEQ ID NO: 35922 - protein, 214 aa, Artificial Sequence; identical to SEQ ID NO: 22079
  Description of Artificial Sequence: Synthetic polypeptide
  XENP022720 2A11_H1_L2.113_Fab-1G6_L1.194_H1.279_scFv Light Chain

SEQ ID NO: 35923 - protein, 107 aa, Artificial Sequence; identical to SEQ ID NO: 22080
  Description of Artificial Sequence: Synthetic polypeptide
  VL of XENP022720

SEQ ID NO: 35924 - protein, 11 aa, Artificial Sequence
  Description of Artificial Sequence: Synthetic peptide
  XENP022720 vlCDR1
QASQDIGNYLN

SEQ ID NO: 35925 - protein, 7 aa, Artificial Sequence
  Description of Artificial Sequence: Synthetic peptide
  XENP022720 vlCDR2
FTSYLHS

SEQ ID NO: 35926 - protein, 9 aa, Artificial Sequence
  Description of Artificial Sequence: Synthetic peptide
  XENP022720 vlCDR3
QQGNTLPYT

SEQ ID NO: 35927 - protein, 450 aa, Artificial Sequence; identical to SEQ ID NO: 35607
  Description of Artificial Sequence: Synthetic polypeptide
  XENP022847 7G8_H3.30_L1.34_Fab-1G6_L1.194_H1.279_scFv Fab-Fc Heavy Chain

SEQ ID NO: 35928 - protein, 121 aa, Artificial Sequence; identical to SEQ ID NO: 22485
  Description of Artificial Sequence: Synthetic polypeptide
  VH of XENP022847

SEQ ID NO: 35929 - protein, 5 aa, Artificial Sequence
  Description of Artificial Sequence: Synthetic peptide
  XENP022847 vhCDR1
DAWMS

SEQ ID NO: 35930 - protein, 19 aa, Artificial Sequence
  Description of Artificial Sequence: Synthetic peptide
  XENP022847 vhCDR2
EISTKANNHATYYAESVKG

SEQ ID NO: 35931 - protein, 10 aa, Artificial Sequence
  Description of Artificial Sequence: Synthetic peptide
  XENP022847 vhCDR3
LATWDWYFDV

SEQ ID NO: 35932 - protein, 480 aa, Artificial Sequence; identical to SEQ ID NO: 23581
  Description of Artificial Sequence: Synthetic polypeptide
  XENP022847 7G8_H3.30_L1.34_Fab-1G6_L1.194_H1.279_scFv scFv-Fc Heavy Chain

SEQ ID NO: 35933 - protein, 107 aa, Artificial Sequence; identical to SEQ ID NO: 10999
  Description of Artificial Sequence: Synthetic polypeptide
  VH of XENP022847

SEQ ID NO: 35934 - protein, 122 aa, Artificial Sequence; identical to SEQ ID NO: 10908
  Description of Artificial Sequence: Synthetic polypeptide
  VL of XENP022847

SEQ ID NO: 35935 - protein, 231 aa, Artificial Sequence; identical to SEQ ID NO: 21572
  Description of Artificial Sequence: Synthetic polypeptide
  Fc chain of XENP022847

SEQ ID NO: 35936 - protein, 11 aa, Artificial Sequence
  Description of Artificial Sequence: Synthetic peptide
  XENP022847 vhCDR1
RASQSVGNDVA

SEQ ID NO: 35937 - protein, 7 aa, Artificial Sequence
  Description of Artificial Sequence: Synthetic peptide
  XENP022847 vhCDR2
YASHRYT

SEQ ID NO: 35938 - protein, 9 aa, Artificial Sequence
  Description of Artificial Sequence: Synthetic peptide
  XENP022847 vhCDR3
QQDFSSPRT

SEQ ID NO: 35939 - protein, 5 aa, Artificial Sequence
  Description of Artificial Sequence: Synthetic peptide
  XENP022847 vlCDR1
NYWMN

SEQ ID NO: 35940 - protein, 19 aa, Artificial Sequence
  Description of Artificial Sequence: Synthetic peptide
  XENP022847 vlCDR2
EIRLYSNNYATHYAESVKG

SEQ ID NO: 35941 - protein, 11 aa, Artificial Sequence
  Description of Artificial Sequence: Synthetic peptide
  XENP022847 vlCDR3
YYGNYGGYFDV

SEQ ID NO: 35942 - protein, 218 aa, Artificial Sequence; identical to SEQ ID NO: 22599
  Description of Artificial Sequence: Synthetic polypeptide
  XENP022847 7G8_H3.30_L1.34_Fab-1G6_L1.194_H1.279_scFv Light Chain

SEQ ID NO: 35943 - protein, 111 aa, Artificial Sequence; identical to SEQ ID NO: 22600
  Description of Artificial Sequence: Synthetic polypeptide
  VL of XENP022847

SEQ ID NO: 35944 - protein, 15 aa, Artificial Sequence
  Description of Artificial Sequence: Synthetic peptide
  XENP022847 vlCDR1
RASQSVDYDGDSYMN

SEQ ID NO: 35945 - protein, 7 aa, Artificial Sequence
  Description of Artificial Sequence: Synthetic peptide
  XENP022847 vlCDR2
AASELES

SEQ ID NO: 35946 - protein, 9 aa, Artificial Sequence
  Description of Artificial Sequence: Synthetic peptide
  XENP022847 vlCDR3
QQSNEDPFT

SEQ ID NO: 35947 - protein, 450 aa, Artificial Sequence; identical to SEQ ID NO: 35607
  Description of Artificial Sequence: Synthetic polypeptide
  XENP022848 7G8_H3.30_L1.36_Fab-1G6_L1.194_H1.279_scFv Fab-Fc Heavy Chain

SEQ ID NO: 35948 - protein, 121 aa, Artificial Sequence; identical to SEQ ID NO: 22485
  Description of Artificial Sequence: Synthetic polypeptide
  VH of XENP022848

SEQ ID NO: 35949 - protein, 5 aa, Artificial Sequence
  Description of Artificial Sequence: Synthetic peptide
  XENP022848 vhCDR1
DAWMS

SEQ ID NO: 35950 - protein, 19 aa, Artificial Sequence
  Description of Artificial Sequence: Synthetic peptide
  XENP022848 vhCDR2
EISTKANNHATYYAESVKG

SEQ ID NO: 35951 - protein, 10 aa, Artificial Sequence
  Description of Artificial Sequence: Synthetic peptide
  XENP022848 vhCDR3
LATWDWYFDV

SEQ ID NO: 35952 - protein, 480 aa, Artificial Sequence; identical to SEQ ID NO: 23581
  Description of Artificial Sequence: Synthetic polypeptide
  XENP022848 7G8_H3.30_L1.36_Fab-1G6_L1.194_H1.279_scFv scFv-Fc Heavy Chain

SEQ ID NO: 35953 - protein, 107 aa, Artificial Sequence; identical to SEQ ID NO: 10999
  Description of Artificial Sequence: Synthetic polypeptide
  VH of XENP022848

SEQ ID NO: 35954 - protein, 122 aa, Artificial Sequence; identical to SEQ ID NO: 10908
  Description of Artificial Sequence: Synthetic polypeptide
  VL of XENP022848

SEQ ID NO: 35955 - protein, 231 aa, Artificial Sequence; identical to SEQ ID NO: 21572
  Description of Artificial Sequence: Synthetic polypeptide
  Fc chain of XENP022848

SEQ ID NO: 35956 - protein, 11 aa, Artificial Sequence
  Description of Artificial Sequence: Synthetic peptide
  XENP022848 vhCDR1
RASQSVGNDVA

SEQ ID NO: 35957 - protein, 7 aa, Artificial Sequence
  Description of Artificial Sequence: Synthetic peptide
  XENP022848 vhCDR2
YASHRYT

SEQ ID NO: 35958 - protein, 9 aa, Artificial Sequence
  Description of Artificial Sequence: Synthetic peptide
  XENP022848 vhCDR3
QQDFSSPRT

SEQ ID NO: 35959 - protein, 5 aa, Artificial Sequence
  Description of Artificial Sequence: Synthetic peptide
  XENP022848 vlCDR1
NYWMN

SEQ ID NO: 35960 - protein, 19 aa, Artificial Sequence
  Description of Artificial Sequence: Synthetic peptide
  XENP022848 vlCDR2
EIRLYSNNYATHYAESVKG

SEQ ID NO: 35961 - protein, 11 aa, Artificial Sequence
  Description of Artificial Sequence: Synthetic peptide
  XENP022848 vlCDR3
YYGNYGGYFDV

SEQ ID NO: 35962 - protein, 218 aa, Artificial Sequence; identical to SEQ ID NO: 22619
  Description of Artificial Sequence: Synthetic polypeptide
  XENP022848 7G8_H3.30_L1.36_Fab-1G6_L1.194_H1.279_scFv Light Chain

SEQ ID NO: 35963 - protein, 111 aa, Artificial Sequence; identical to SEQ ID NO: 22620
  Description of Artificial Sequence: Synthetic polypeptide
  VL of XENP022848

SEQ ID NO: 35964 - protein, 15 aa, Artificial Sequence
  Description of Artificial Sequence: Synthetic peptide
  XENP022848 vlCDR1
RASQSVDHDGDSYMN

SEQ ID NO: 35965 - protein, 7 aa, Artificial Sequence
  Description of Artificial Sequence: Synthetic peptide
  XENP022848 vlCDR2
AASELES

SEQ ID NO: 35966 - protein, 9 aa, Artificial Sequence
  Description of Artificial Sequence: Synthetic peptide
  XENP022848 vlCDR3
QQSNEDPFT

SEQ ID NO: 35967 - protein, 447 aa, Artificial Sequence; identical to SEQ ID NO: 35647
  Description of Artificial Sequence: Synthetic polypeptide
  XENP022849 2A11_H1.144_L2.142_Fab-1G6_L1.194_H1.279_scFv Fab-Fc Heavy Chain

SEQ ID NO: 35968 - protein, 118 aa, Artificial Sequence; identical to SEQ ID NO: 22085
  Description of Artificial Sequence: Synthetic polypeptide
  VH of XENP022849

SEQ ID NO: 35969 - protein, 5 aa, Artificial Sequence
  Description of Artificial Sequence: Synthetic peptide
  XENP022849 vhCDR1
DYFMH

SEQ ID NO: 35970 - protein, 17 aa, Artificial Sequence
  Description of Artificial Sequence: Synthetic peptide
  XENP022849 vhCDR2
WIDPELGDTEYAPKFQG

SEQ ID NO: 35971 - protein, 9 aa, Artificial Sequence
  Description of Artificial Sequence: Synthetic peptide
  XENP022849 vhCDR3
RGVYQALDY

SEQ ID NO: 35972 - protein, 480 aa, Artificial Sequence; identical to SEQ ID NO: 23581
  Description of Artificial Sequence: Synthetic polypeptide
  XENP022849 2A11_H1.144_L2.142_Fab-1G6_L1.194_H1.279_scFv scFv-Fc Heavy Chain

SEQ ID NO: 35973 - protein, 107 aa, Artificial Sequence; identical to SEQ ID NO: 10999
  Description of Artificial Sequence: Synthetic polypeptide
  VH of XENP022849

SEQ ID NO: 35974 - protein, 122 aa, Artificial Sequence; identical to SEQ ID NO: 10908
  Description of Artificial Sequence: Synthetic polypeptide
  VL of XENP022849

SEQ ID NO: 35975 - protein, 231 aa, Artificial Sequence; identical to SEQ ID NO: 21572
  Description of Artificial Sequence: Synthetic polypeptide
  Fc chain of XENP022849

SEQ ID NO: 35976 - protein, 11 aa, Artificial Sequence
  Description of Artificial Sequence: Synthetic peptide
  XENP022849 vhCDR1
RASQSVGNDVA

SEQ ID NO: 35977 - protein, 7 aa, Artificial Sequence
  Description of Artificial Sequence: Synthetic peptide
  XENP022849 vhCDR2
YASHRYT

SEQ ID NO: 35978 - protein, 9 aa, Artificial Sequence
  Description of Artificial Sequence: Synthetic peptide
  XENP022849 vhCDR3
QQDFSSPRT

SEQ ID NO: 35979 - protein, 5 aa, Artificial Sequence
  Description of Artificial Sequence: Synthetic peptide
  XENP022849 vlCDR1
NYWMN

SEQ ID NO: 35980 - protein, 19 aa, Artificial Sequence
  Description of Artificial Sequence: Synthetic peptide
  XENP022849 vlCDR2
EIRLYSNNYATHYAESVKG

SEQ ID NO: 35981 - protein, 11 aa, Artificial Sequence
  Description of Artificial Sequence: Synthetic peptide
  XENP022849 vlCDR3
YYGNYGGYFDV

SEQ ID NO: 35982 - protein, 214 aa, Artificial Sequence; identical to SEQ ID NO: 22279
  Description of Artificial Sequence: Synthetic polypeptide
  XENP022849 2A11_H1.144_L2.142_Fab-1G6_L1.194_H1.279_scFv Light Chain

SEQ ID NO: 35983 - protein, 107 aa, Artificial Sequence; identical to SEQ ID NO: 22280
  Description of Artificial Sequence: Synthetic polypeptide
  VL of XENP022849

SEQ ID NO: 35984 - protein, 11 aa, Artificial Sequence
  Description of Artificial Sequence: Synthetic peptide
  XENP022849 vlCDR1
QASQDIGNYLN

SEQ ID NO: 35985 - protein, 7 aa, Artificial Sequence
  Description of Artificial Sequence: Synthetic peptide
  XENP022849 vlCDR2
FTSYLHS

SEQ ID NO: 35986 - protein, 9 aa, Artificial Sequence
  Description of Artificial Sequence: Synthetic peptide
  XENP022849 vlCDR3
QQGNTLPYT

SEQ ID NO: 35987 - protein, 447 aa, Artificial Sequence; identical to SEQ ID NO: 35647
  Description of Artificial Sequence: Synthetic polypeptide
  XENP022850 2A11_H1.144_L2.113_Fab-1G6_L1.194_H1.279_scFv Fab -Fc Heavy Chain

SEQ ID NO: 35988 - protein, 118 aa, Artificial Sequence; identical to SEQ ID NO: 22085
  Description of Artificial Sequence: Synthetic polypeptide
  VH of XENP022850

SEQ ID NO: 35989 - protein, 5 aa, Artificial Sequence
  Description of Artificial Sequence: Synthetic peptide
  XENP022850 vhCDR1
DYFMH

SEQ ID NO: 35990 - protein, 17 aa, Artificial Sequence
  Description of Artificial Sequence: Synthetic peptide
  XENP022850 vhCDR2
WIDPELGDTEYAPKFQG

SEQ ID NO: 35991 - protein, 9 aa, Artificial Sequence
  Description of Artificial Sequence: Synthetic peptide
  XENP022850 vhCDR3
RGVYQALDY

SEQ ID NO: 35992 - protein, 480 aa, Artificial Sequence; identical to SEQ ID NO: 23581
  Description of Artificial Sequence: Synthetic polypeptide
  XENP022850 2A11_H1.144_L2.113_Fab-1G6_L1.194_H1.279_scFv scFv -Fc Heavy Chain

SEQ ID NO: 35993 - protein, 107 aa, Artificial Sequence; identical to SEQ ID NO: 10999
  Description of Artificial Sequence: Synthetic polypeptide
  VH of XENP022850

SEQ ID NO: 35994 - protein, 122 aa, Artificial Sequence; identical to SEQ ID NO: 10908
  Description of Artificial Sequence: Synthetic polypeptide
  VL of XENP022850

SEQ ID NO: 35995 - protein, 231 aa, Artificial Sequence; identical to SEQ ID NO: 21572
  Description of Artificial Sequence: Synthetic polypeptide
  Fc chain of XENP022850

SEQ ID NO: 35996 - protein, 11 aa, Artificial Sequence
  Description of Artificial Sequence: Synthetic peptide
  XENP022850 vhCDR1
RASQSVGNDVA

SEQ ID NO: 35997 - protein, 7 aa, Artificial Sequence
  Description of Artificial Sequence: Synthetic peptide
  XENP022850 vhCDR2
YASHRYT

SEQ ID NO: 35998 - protein, 9 aa, Artificial Sequence
  Description of Artificial Sequence: Synthetic peptide
  XENP022850 vhCDR3
QQDFSSPRT

SEQ ID NO: 35999 - protein, 5 aa, Artificial Sequence
  Description of Artificial Sequence: Synthetic peptide
  XENP022850 vlCDR1
NYWMN

SEQ ID NO: 36000 - protein, 19 aa, Artificial Sequence
  Description of Artificial Sequence: Synthetic peptide
  XENP022850 vlCDR2
EIRLYSNNYATHYAESVKG

SEQ ID NO: 36001 - protein, 11 aa, Artificial Sequence
  Description of Artificial Sequence: Synthetic peptide
  XENP022850 vlCDR3
YYGNYGGYFDV

SEQ ID NO: 36002 - protein, 214 aa, Artificial Sequence; identical to SEQ ID NO: 22079
  Description of Artificial Sequence: Synthetic polypeptide
  XENP022850 2A11_H1.144_L2.113_Fab-1G6_L1.194_H1.279_scFv Light Chain

SEQ ID NO: 36003 - protein, 107 aa, Artificial Sequence; identical to SEQ ID NO: 22080
  Description of Artificial Sequence: Synthetic polypeptide
  VL of XENP022850

SEQ ID NO: 36004 - protein, 11 aa, Artificial Sequence
  Description of Artificial Sequence: Synthetic peptide
  XENP022850 vlCDR1
QASQDIGNYLN

SEQ ID NO: 36005 - protein, 7 aa, Artificial Sequence
  Description of Artificial Sequence: Synthetic peptide
  XENP022850 vlCDR2
FTSYLHS

SEQ ID NO: 36006 - protein, 9 aa, Artificial Sequence
  Description of Artificial Sequence: Synthetic peptide
  XENP022850 vlCDR3
QQGNTLPYT

SEQ ID NO: 36007 - protein, 447 aa, Artificial Sequence; identical to SEQ ID NO: 35707
  Description of Artificial Sequence: Synthetic polypeptide
  XENP022851 2A11_H1.125_L2.126_Fab-1G6_L1.194_H1.279_scFv Fab-Fc Heavy Chain

SEQ ID NO: 36008 - protein, 118 aa, Artificial Sequence; identical to SEQ ID NO: 22065
  Description of Artificial Sequence: Synthetic polypeptide
  VH of XENP022851

SEQ ID NO: 36009 - protein, 5 aa, Artificial Sequence
  Description of Artificial Sequence: Synthetic peptide
  XENP022851 vhCDR1
HYFMH

SEQ ID NO: 36010 - protein, 17 aa, Artificial Sequence
  Description of Artificial Sequence: Synthetic peptide
  XENP022851 vhCDR2
WIDPYLGDTEYAPKFQG

SEQ ID NO: 36011 - protein, 9 aa, Artificial Sequence
  Description of Artificial Sequence: Synthetic peptide
  XENP022851 vhCDR3
RGVYQALDY

SEQ ID NO: 36012 - protein, 480 aa, Artificial Sequence; identical to SEQ ID NO: 23581
  Description of Artificial Sequence: Synthetic polypeptide
  XENP022851 2A11_H1.125_L2.126_Fab-1G6_L1.194_H1.279_scFv scFv-Fc Heavy Chain

SEQ ID NO: 36013 - protein, 107 aa, Artificial Sequence; identical to SEQ ID NO: 10999
  Description of Artificial Sequence: Synthetic polypeptide
  VH of XENP022851

SEQ ID NO: 36014 - protein, 122 aa, Artificial Sequence; identical to SEQ ID NO: 10908
  Description of Artificial Sequence: Synthetic polypeptide
  VL of XENP022851

SEQ ID NO: 36015 - protein, 231 aa, Artificial Sequence; identical to SEQ ID NO: 21572
  Description of Artificial Sequence: Synthetic polypeptide
  Fc chain of XENP022851

SEQ ID NO: 36016 - protein, 11 aa, Artificial Sequence
  Description of Artificial Sequence: Synthetic peptide
  XENP022851 vhCDR1
RASQSVGNDVA

SEQ ID NO: 36017 - protein, 7 aa, Artificial Sequence
  Description of Artificial Sequence: Synthetic peptide
  XENP022851 vhCDR2
YASHRYT

SEQ ID NO: 36018 - protein, 9 aa, Artificial Sequence
  Description of Artificial Sequence: Synthetic peptide
  XENP022851 vhCDR3
QQDFSSPRT

SEQ ID NO: 36019 - protein, 5 aa, Artificial Sequence
  Description of Artificial Sequence: Synthetic peptide
  XENP022851 vlCDR1
NYWMN

SEQ ID NO: 36020 - protein, 19 aa, Artificial Sequence
  Description of Artificial Sequence: Synthetic peptide
  XENP022851 vlCDR2
EIRLYSNNYATHYAESVKG

SEQ ID NO: 36021 - protein, 11 aa, Artificial Sequence
  Description of Artificial Sequence: Synthetic peptide
  XENP022851 vlCDR3
YYGNYGGYFDV

SEQ ID NO: 36022 - protein, 214 aa, Artificial Sequence; identical to SEQ ID NO: 22259
  Description of Artificial Sequence: Synthetic polypeptide
  XENP022851 2A11_H1.125_L2.126_Fab-1G6_L1.194_H1.279_scFv Light Chain

SEQ ID NO: 36023 - protein, 107 aa, Artificial Sequence; identical to SEQ ID NO: 22260
  Description of Artificial Sequence: Synthetic polypeptide
  VL of XENP022851

SEQ ID NO: 36024 - protein, 11 aa, Artificial Sequence
  Description of Artificial Sequence: Synthetic peptide
  XENP022851 vlCDR1
QASQDIGNYLN

SEQ ID NO: 36025 - protein, 7 aa, Artificial Sequence
  Description of Artificial Sequence: Synthetic peptide
  XENP022851 vlCDR2
FTSYLHS

SEQ ID NO: 36026 - protein, 9 aa, Artificial Sequence
  Description of Artificial Sequence: Synthetic peptide
  XENP022851 vlCDR3
QEGNTLPYT

SEQ ID NO: 36027 - protein, 447 aa, Artificial Sequence; identical to SEQ ID NO: 21564
  Description of Artificial Sequence: Synthetic polypeptide
  XENP022852 2A11_H1_L2.113_Fab-1G6_L1.194_H1.279_scFv Fab-Fc Heavy Chain

SEQ ID NO: 36028 - protein, 118 aa, Artificial Sequence; identical to SEQ ID NO: 17236
  Description of Artificial Sequence: Synthetic polypeptide
  VH of XENP022852

SEQ ID NO: 36029 - protein, 5 aa, Artificial Sequence
  Description of Artificial Sequence: Synthetic peptide
  XENP022852 vhCDR1
DYYMH

SEQ ID NO: 36030 - protein, 17 aa, Artificial Sequence
  Description of Artificial Sequence: Synthetic peptide
  XENP022852 vhCDR2
WIDPENGDTEYAPKFQG

SEQ ID NO: 36031 - protein, 9 aa, Artificial Sequence
  Description of Artificial Sequence: Synthetic peptide
  XENP022852 vhCDR3
RGVRQALDY

SEQ ID NO: 36032 - protein, 480 aa, Artificial Sequence; identical to SEQ ID NO: 23581
  Description of Artificial Sequence: Synthetic polypeptide
  XENP022852 2A11_H1_L2.113_Fab-1G6_L1.194_H1.279_scFv scFv-Fc Heavy Chain

SEQ ID NO: 36033 - protein, 107 aa, Artificial Sequence; identical to SEQ ID NO: 10999
  Description of Artificial Sequence: Synthetic polypeptide
  VH of XENP022852

SEQ ID NO: 36034 - protein, 122 aa, Artificial Sequence; identical to SEQ ID NO: 10908
  Description of Artificial Sequence: Synthetic polypeptide
  VL of XENP022852

SEQ ID NO: 36035 - protein, 231 aa, Artificial Sequence; identical to SEQ ID NO: 21572
  Description of Artificial Sequence: Synthetic polypeptide
  Fc chain of XENP022852

SEQ ID NO: 36036 - protein, 11 aa, Artificial Sequence
  Description of Artificial Sequence: Synthetic peptide
  XENP022852 vhCDR1
RASQSVGNDVA

SEQ ID NO: 36037 - protein, 7 aa, Artificial Sequence
  Description of Artificial Sequence: Synthetic peptide
  XENP022852 vhCDR2
YASHRYT

SEQ ID NO: 36038 - protein, 9 aa, Artificial Sequence
  Description of Artificial Sequence: Synthetic peptide
  XENP022852 vhCDR3
QQDFSSPRT

SEQ ID NO: 36039 - protein, 5 aa, Artificial Sequence
  Description of Artificial Sequence: Synthetic peptide
  XENP022852 vlCDR1
NYWMN

SEQ ID NO: 36040 - protein, 19 aa, Artificial Sequence
  Description of Artificial Sequence: Synthetic peptide
  XENP022852 vlCDR2
EIRLYSNNYATHYAESVKG

SEQ ID NO: 36041 - protein, 11 aa, Artificial Sequence
  Description of Artificial Sequence: Synthetic peptide
  XENP022852 vlCDR3
YYGNYGGYFDV

SEQ ID NO: 36042 - protein, 214 aa, Artificial Sequence; identical to SEQ ID NO: 22079
  Description of Artificial Sequence: Synthetic polypeptide
  XENP022852 2A11_H1_L2.113_Fab-1G6_L1.194_H1.279_scFv Light Chain

SEQ ID NO: 36043 - protein, 107 aa, Artificial Sequence; identical to SEQ ID NO: 22080
  Description of Artificial Sequence: Synthetic polypeptide
  VL of XENP022852

SEQ ID NO: 36044 - protein, 11 aa, Artificial Sequence
  Description of Artificial Sequence: Synthetic peptide
  XENP022852 vlCDR1
QASQDIGNYLN

SEQ ID NO: 36045 - protein, 7 aa, Artificial Sequence
  Description of Artificial Sequence: Synthetic peptide
  XENP022852 vlCDR2
FTSYLHS

SEQ ID NO: 36046 - protein, 9 aa, Artificial Sequence
  Description of Artificial Sequence: Synthetic peptide
  XENP022852 vlCDR3
QQGNTLPYT

SEQ ID NO: 36047 - protein, 447 aa, Artificial Sequence; identical to SEQ ID NO: 17235
  Description of Artificial Sequence: Synthetic polypeptide
  XENP023349 2A11_H1L2_Fab-1C11_H3L3_scFv Fab-Fc Heavy Chain

SEQ ID NO: 36048 - protein, 118 aa, Artificial Sequence; identical to SEQ ID NO: 17236
  Description of Artificial Sequence: Synthetic polypeptide
  VH of XENP023349

SEQ ID NO: 36049 - protein, 5 aa, Artificial Sequence
  Description of Artificial Sequence: Synthetic peptide
  XENP023349 vhCDR1
DYYMH

SEQ ID NO: 36050 - protein, 17 aa, Artificial Sequence
  Description of Artificial Sequence: Synthetic peptide
  XENP023349 vhCDR2
WIDPENGDTEYAPKFQG

SEQ ID NO: 36051 - protein, 9 aa, Artificial Sequence
  Description of Artificial Sequence: Synthetic peptide
  XENP023349 vhCDR3
RGVRQALDY

SEQ ID NO: 36052 - protein, 480 aa, Artificial Sequence
  Description of Artificial Sequence: Synthetic polypeptide
  XENP023349 2A11_H1L2_Fab-1C11_H3L3_scFv scFv-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36053 - protein, 117 aa, Artificial Sequence; identical to SEQ ID NO: 33034
  Description of Artificial Sequence: Synthetic polypeptide
  VH of XENP023349

SEQ ID NO: 36054 - protein, 112 aa, Artificial Sequence; identical to SEQ ID NO: 33009
  Description of Artificial Sequence: Synthetic polypeptide
  VL of XENP023349

SEQ ID NO: 36055 - protein, 231 aa, Artificial Sequence; identical to SEQ ID NO: 21532
  Description of Artificial Sequence: Synthetic polypeptide
  Fc chain of XENP023349

SEQ ID NO: 36056 - protein, 5 aa, Artificial Sequence
  Description of Artificial Sequence: Synthetic peptide
  XENP023349 vhCDR1
HYGMN

SEQ ID NO: 36057 - protein, 17 aa, Artificial Sequence
  Description of Artificial Sequence: Synthetic peptide
  XENP023349 vhCDR2
WINTYTGEPTYADGFTG

SEQ ID NO: 36058 - protein, 8 aa, Artificial Sequence
  Description of Artificial Sequence: Synthetic peptide
  XENP023349 vhCDR3
DYYGSSPY

SEQ ID NO: 36059 - protein, 16 aa, Artificial Sequence
  Description of Artificial Sequence: Synthetic peptide
  XENP023349 vlCDR1
KSSQSIVHSNGNTYLE

SEQ ID NO: 36060 - protein, 7 aa, Artificial Sequence
  Description of Artificial Sequence: Synthetic peptide
  XENP023349 vlCDR2
KVSNRFS

SEQ ID NO: 36061 - protein, 9 aa, Artificial Sequence
  Description of Artificial Sequence: Synthetic peptide
  XENP023349 vlCDR3
FQGSHVPNT

SEQ ID NO: 36062 - protein, 214 aa, Artificial Sequence; identical to SEQ ID NO: 17250
  Description of Artificial Sequence: Synthetic polypeptide
  XENP023349 2A11_H1L2_Fab-1C11_H3L3_scFv Light Chain

SEQ ID NO: 36063 - protein, 107 aa, Artificial Sequence; identical to SEQ ID NO: 17251
  Description of Artificial Sequence: Synthetic polypeptide
  VL of XENP023349

SEQ ID NO: 36064 - protein, 11 aa, Artificial Sequence
  Description of Artificial Sequence: Synthetic peptide
  XENP023349 vlCDR1
QASQDIGNYLN

SEQ ID NO: 36065 - protein, 7 aa, Artificial Sequence
  Description of Artificial Sequence: Synthetic peptide
  XENP023349 vlCDR2
YTSRLHS

SEQ ID NO: 36066 - protein, 9 aa, Artificial Sequence
  Description of Artificial Sequence: Synthetic peptide
  XENP023349 vlCDR3
QQGNTLPYT

SEQ ID NO: 36067 - protein, 447 aa, Artificial Sequence; identical to SEQ ID NO: 22084
  Description of Artificial Sequence: Synthetic polypeptide
  XENP023350 2A11_H1.144_L2.142_Fab-1C11_H3L3_scFv Fab-Fc Heavy Chain

SEQ ID NO: 36068 - protein, 118 aa, Artificial Sequence; identical to SEQ ID NO: 22085
  Description of Artificial Sequence: Synthetic polypeptide
  VH of XENP023350

SEQ ID NO: 36069 - protein, 5 aa, Artificial Sequence
  Description of Artificial Sequence: Synthetic peptide
  XENP023350 vhCDR1
DYFMH

SEQ ID NO: 36070 - protein, 17 aa, Artificial Sequence
  Description of Artificial Sequence: Synthetic peptide
  XENP023350 vhCDR2
WIDPELGDTEYAPKFQG

SEQ ID NO: 36071 - protein, 9 aa, Artificial Sequence
  Description of Artificial Sequence: Synthetic peptide
  XENP023350 vhCDR3
RGVYQALDY

SEQ ID NO: 36072 - protein, 480 aa, Artificial Sequence; identical to SEQ ID NO: 36052
  Description of Artificial Sequence: Synthetic polypeptide
  XENP023350 2A11_H1.144_L2.142_Fab-1C11_H3L3_scFv scFv-Fc Heavy Chain

SEQ ID NO: 36073 - protein, 117 aa, Artificial Sequence; identical to SEQ ID NO: 33034
  Description of Artificial Sequence: Synthetic polypeptide
  VH of XENP023350

SEQ ID NO: 36074 - protein, 112 aa, Artificial Sequence; identical to SEQ ID NO: 33009
  Description of Artificial Sequence: Synthetic polypeptide
  VL of XENP023350

SEQ ID NO: 36075 - protein, 231 aa, Artificial Sequence; identical to SEQ ID NO: 21532
  Description of Artificial Sequence: Synthetic polypeptide
  Fc chain of XENP023350

SEQ ID NO: 36076 - protein, 5 aa, Artificial Sequence
  Description of Artificial Sequence: Synthetic peptide
  XENP023350 vhCDR1
HYGMN

SEQ ID NO: 36077 - protein, 17 aa, Artificial Sequence
  Description of Artificial Sequence: Synthetic peptide
  XENP023350 vhCDR2
WINTYTGEPTYADGFTG

SEQ ID NO: 36078 - protein, 8 aa, Artificial Sequence
  Description of Artificial Sequence: Synthetic peptide
  XENP023350 vhCDR3
DYYGSSPY

SEQ ID NO: 36079 - protein, 16 aa, Artificial Sequence
  Description of Artificial Sequence: Synthetic peptide
  XENP023350 vlCDR1
KSSQSIVHSNGNTYLE

SEQ ID NO: 36080 - protein, 7 aa, Artificial Sequence
  Description of Artificial Sequence: Synthetic peptide
  XENP023350 vlCDR2
KVSNRFS

SEQ ID NO: 36081 - protein, 9 aa, Artificial Sequence
  Description of Artificial Sequence: Synthetic peptide
  XENP023350 vlCDR3
FQGSHVPNT

SEQ ID NO: 36082 - protein, 214 aa, Artificial Sequence; identical to SEQ ID NO: 22279
  Description of Artificial Sequence: Synthetic polypeptide
  XENP023350 2A11_H1.144_L2.142_Fab-1C11_H3L3_scFv Light Chain

SEQ ID NO: 36083 - protein, 107 aa, Artificial Sequence; identical to SEQ ID NO: 22280
  Description of Artificial Sequence: Synthetic polypeptide
  VL of XENP023350

SEQ ID NO: 36084 - protein, 11 aa, Artificial Sequence
  Description of Artificial Sequence: Synthetic peptide
  XENP023350 vlCDR1
QASQDIGNYLN

SEQ ID NO: 36085 - protein, 7 aa, Artificial Sequence
  Description of Artificial Sequence: Synthetic peptide
  XENP023350 vlCDR2
FTSYLHS

SEQ ID NO: 36086 - protein, 9 aa, Artificial Sequence
  Description of Artificial Sequence: Synthetic peptide
  XENP023350 vlCDR3
QQGNTLPYT

SEQ ID NO: 36087 - protein, 447 aa, Artificial Sequence; identical to SEQ ID NO: 17235
  Description of Artificial Sequence: Synthetic polypeptide
  XENP023351 2A11_H1L2_Fab-2E9_H1L1_scFv Fab-Fc Heavy Chain

SEQ ID NO: 36088 - protein, 118 aa, Artificial Sequence; identical to SEQ ID NO: 17236
  Description of Artificial Sequence: Synthetic polypeptide
  VH of XENP023351

SEQ ID NO: 36089 - protein, 5 aa, Artificial Sequence
  Description of Artificial Sequence: Synthetic peptide
  XENP023351 vhCDR1
DYYMH

SEQ ID NO: 36090 - protein, 17 aa, Artificial Sequence
  Description of Artificial Sequence: Synthetic peptide
  XENP023351 vhCDR2
WIDPENGDTEYAPKFQG

SEQ ID NO: 36091 - protein, 9 aa, Artificial Sequence
  Description of Artificial Sequence: Synthetic peptide
  XENP023351 vhCDR3
RGVRQALDY

SEQ ID NO: 36092 - protein, 478 aa, Artificial Sequence
  Description of Artificial Sequence: Synthetic polypeptide
  XENP023351 2A11_H1L2_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36093 - protein, 120 aa, Artificial Sequence; identical to SEQ ID NO: 11412
  Description of Artificial Sequence: Synthetic polypeptide
  VH of XENP023351

SEQ ID NO: 36094 - protein, 107 aa, Artificial Sequence; identical to SEQ ID NO: 11413
  Description of Artificial Sequence: Synthetic polypeptide
  VL of XENP023351

SEQ ID NO: 36095 - protein, 231 aa, Artificial Sequence; identical to SEQ ID NO: 21532
  Description of Artificial Sequence: Synthetic polypeptide
  Fc chain of XENP023351

SEQ ID NO: 36096 - protein, 5 aa, Artificial Sequence
  Description of Artificial Sequence: Synthetic peptide
  XENP023351 vhCDR1
NYWLG

SEQ ID NO: 36097 - protein, 17 aa, Artificial Sequence
  Description of Artificial Sequence: Synthetic peptide
  XENP023351 vhCDR2
NFYPGSSNTYYNEKFQG

SEQ ID NO: 36098 - protein, 11 aa, Artificial Sequence
  Description of Artificial Sequence: Synthetic peptide
  XENP023351 vhCDR3
HYGTNYRYFDV

SEQ ID NO: 36099 - protein, 11 aa, Artificial Sequence
  Description of Artificial Sequence: Synthetic peptide
  XENP023351 vlCDR1
RASQSVSNDVA

SEQ ID NO: 36100 - protein, 7 aa, Artificial Sequence
  Description of Artificial Sequence: Synthetic peptide
  XENP023351 vlCDR2
YASNRYT

SEQ ID NO: 36101 - protein, 9 aa, Artificial Sequence
  Description of Artificial Sequence: Synthetic peptide
  XENP023351 vlCDR3
QQDYSSPYT

SEQ ID NO: 36102 - protein, 214 aa, Artificial Sequence; identical to SEQ ID NO: 17250
  Description of Artificial Sequence: Synthetic polypeptide
  XENP023351 2A11_H1L2_Fab-2E9_H1L1_scFv Light Chain

SEQ ID NO: 36103 - protein, 107 aa, Artificial Sequence; identical to SEQ ID NO: 17251
  Description of Artificial Sequence: Synthetic polypeptide
  VL of XENP023351

SEQ ID NO: 36104 - protein, 11 aa, Artificial Sequence
  Description of Artificial Sequence: Synthetic peptide
  XENP023351 vlCDR1
QASQDIGNYLN

SEQ ID NO: 36105 - protein, 7 aa, Artificial Sequence
  Description of Artificial Sequence: Synthetic peptide
  XENP023351 vlCDR2
YTSRLHS

SEQ ID NO: 36106 - protein, 9 aa, Artificial Sequence
  Description of Artificial Sequence: Synthetic peptide
  XENP023351 vlCDR3
QQGNTLPYT

SEQ ID NO: 36107 - protein, 447 aa, Artificial Sequence; identical to SEQ ID NO: 22084
  Description of Artificial Sequence: Synthetic polypeptide
  XENP023352 2A11_H1.144_L2.142_Fab-2E9_H1L1_scFv Fab-Fc Heavy Chain

SEQ ID NO: 36108 - protein, 118 aa, Artificial Sequence; identical to SEQ ID NO: 22085
  Description of Artificial Sequence: Synthetic polypeptide
  VH of XENP023352

SEQ ID NO: 36109 - protein, 5 aa, Artificial Sequence
  Description of Artificial Sequence: Synthetic peptide
  XENP023352 vhCDR1
DYFMH

SEQ ID NO: 36110 - protein, 17 aa, Artificial Sequence
  Description of Artificial Sequence: Synthetic peptide
  XENP023352 vhCDR2
WIDPELGDTEYAPKFQG

SEQ ID NO: 36111 - protein, 9 aa, Artificial Sequence
  Description of Artificial Sequence: Synthetic peptide
  XENP023352 vhCDR3
RGVYQALDY

SEQ ID NO: 36112 - protein, 458 aa, Artificial Sequence
  Description of Artificial Sequence: Synthetic polypeptide
  XENP023352 2A11_H1.144_L2.142_Fab-2E9_H1L1_scFv scFv-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36113 - protein, 120 aa, Artificial Sequence; identical to SEQ ID NO: 11412
  Description of Artificial Sequence: Synthetic polypeptide
  VH of XENP023352

SEQ ID NO: 36114 - protein, 107 aa, Artificial Sequence; identical to SEQ ID NO: 11413
  Description of Artificial Sequence: Synthetic polypeptide
  VL of XENP023352

SEQ ID NO: 36115 - protein, 231 aa, Artificial Sequence; identical to SEQ ID NO: 21532
  Description of Artificial Sequence: Synthetic polypeptide
  Fc chain of XENP023352

SEQ ID NO: 36116 - protein, 5 aa, Artificial Sequence
  Description of Artificial Sequence: Synthetic peptide
  XENP023352 vhCDR1
NYWLG

SEQ ID NO: 36117 - protein, 17 aa, Artificial Sequence
  Description of Artificial Sequence: Synthetic peptide
  XENP023352 vhCDR2
NFYPGSSNTYYNEKFQG

SEQ ID NO: 36118 - protein, 11 aa, Artificial Sequence
  Description of Artificial Sequence: Synthetic peptide
  XENP023352 vhCDR3
HYGTNYRYFDV

SEQ ID NO: 36119 - protein, 11 aa, Artificial Sequence
  Description of Artificial Sequence: Synthetic peptide
  XENP023352 vlCDR1
RASQSVSNDVA

SEQ ID NO: 36120 - protein, 7 aa, Artificial Sequence
  Description of Artificial Sequence: Synthetic peptide
  XENP023352 vlCDR2
YASNRYT

SEQ ID NO: 36121 - protein, 9 aa, Artificial Sequence
  Description of Artificial Sequence: Synthetic peptide
  XENP023352 vlCDR3
QQDYSSPYT

SEQ ID NO: 36122 - protein, 214 aa, Artificial Sequence; identical to SEQ ID NO: 22279
  Description of Artificial Sequence: Synthetic polypeptide
  XENP023352 2A11_H1.144_L2.142_Fab-2E9_H1L1_scFv Light Chain

SEQ ID NO: 36123 - protein, 107 aa, Artificial Sequence; identical to SEQ ID NO: 22280
  Description of Artificial Sequence: Synthetic polypeptide
  VL of XENP023352

SEQ ID NO: 36124 - protein, 11 aa, Artificial Sequence
  Description of Artificial Sequence: Synthetic peptide
  XENP023352 vlCDR1
QASQDIGNYLN

SEQ ID NO: 36125 - protein, 7 aa, Artificial Sequence
  Description of Artificial Sequence: Synthetic peptide
  XENP023352 vlCDR2
FTSYLHS

SEQ ID NO: 36126 - protein, 9 aa, Artificial Sequence
  Description of Artificial Sequence: Synthetic peptide
  XENP023352 vlCDR3
QQGNTLPYT

SEQ ID NO: 36127 - protein, 446 aa, Artificial Sequence
  Description of Artificial Sequence: Synthetic polypeptide
  XENP022856 1C11_H3L3_IgG1_PVA_/S267K/M428L/N434S Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 36128 - protein, 117 aa, Artificial Sequence; identical to SEQ ID NO: 33034
  Description of Artificial Sequence: Synthetic polypeptide
  VH of XENP022856

SEQ ID NO: 36129 - protein, 5 aa, Artificial Sequence
  Description of Artificial Sequence: Synthetic peptide
  XENP022856 vhCDR1
HYGMN

SEQ ID NO: 36130 - protein, 17 aa, Artificial Sequence
  Description of Artificial Sequence: Synthetic peptide
  XENP022856 vhCDR2
WINTYTGEPTYADGFTG

SEQ ID NO: 36131 - protein, 8 aa, Artificial Sequence
  Description of Artificial Sequence: Synthetic peptide
  XENP022856 vhCDR3
DYYGSSPY

SEQ ID NO: 36132 - protein, 219 aa, Artificial Sequence; identical to SEQ ID NO: 33008
  Description of Artificial Sequence: Synthetic polypeptide
  XENP022856 1C11_H3L3_IgG1_PVA_/S267K/M428L/N434S Light Chain

SEQ ID NO: 36133 - protein, 112 aa, Artificial Sequence; identical to SEQ ID NO: 33009
  Description of Artificial Sequence: Synthetic polypeptide
  VL of XENP022856

SEQ ID NO: 36134 - protein, 16 aa, Artificial Sequence
  Description of Artificial Sequence: Synthetic peptide
  XENP022856 vlCDR1
KSSQSIVHSNGNTYLE

SEQ ID NO: 36135 - protein, 7 aa, Artificial Sequence
  Description of Artificial Sequence: Synthetic peptide
  XENP022856 vlCDR2
KVSNRFS

SEQ ID NO: 36136 - protein, 9 aa, Artificial Sequence
  Description of Artificial Sequence: Synthetic peptide
  XENP022856 vlCDR3
FQGSHVPNT

SEQ ID NO: 36137 - protein, 449 aa, Artificial Sequence
  Description of Artificial Sequence: Synthetic polypeptide
  XENP022857 2E9_H1L1_IgG1_PVA_/S267K/M428L/N434S Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 36138 - protein, 120 aa, Artificial Sequence; identical to SEQ ID NO: 11412
  Description of Artificial Sequence: Synthetic polypeptide
  VH of XENP022857

SEQ ID NO: 36139 - protein, 5 aa, Artificial Sequence
  Description of Artificial Sequence: Synthetic peptide
  XENP022857 vhCDR1
NYWLG

SEQ ID NO: 36140 - protein, 17 aa, Artificial Sequence
  Description of Artificial Sequence: Synthetic peptide
  XENP022857 vhCDR2
NFYPGSSNTYYNEKFQG

SEQ ID NO: 36141 - protein, 11 aa, Artificial Sequence
  Description of Artificial Sequence: Synthetic peptide
  XENP022857 vhCDR3
HYGTNYRYFDV

SEQ ID NO: 36142 - protein, 214 aa, Artificial Sequence; identical to SEQ ID NO: 17080
  Description of Artificial Sequence: Synthetic polypeptide
  XENP022857 2E9_H1L1_IgG1_PVA_/S267K/M428L/N434S Light Chain

SEQ ID NO: 36143 - protein, 107 aa, Artificial Sequence; identical to SEQ ID NO: 11413
  Description of Artificial Sequence: Synthetic polypeptide
  VL of XENP022857

SEQ ID NO: 36144 - protein, 11 aa, Artificial Sequence
  Description of Artificial Sequence: Synthetic peptide
  XENP022857 vlCDR1
RASQSVSNDVA

SEQ ID NO: 36145 - protein, 7 aa, Artificial Sequence
  Description of Artificial Sequence: Synthetic peptide
  XENP022857 vlCDR2
YASNRYT

SEQ ID NO: 36146 - protein, 9 aa, Artificial Sequence
  Description of Artificial Sequence: Synthetic peptide
  XENP022857 vlCDR3
QQDYSSPYT

SEQ ID NO: 36147 - protein, 447 aa, Artificial Sequence
  Description of Artificial Sequence: Synthetic polypeptide
  XENP022858 9C6_H1.1_L1_Fab-1G6_L1.194_H1.279_scFv Fab-Fc Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36148 - protein, 118 aa, Artificial Sequence; identical to SEQ ID NO: 21205
  Description of Artificial Sequence: Synthetic polypeptide
  VH of XENP022858

SEQ ID NO: 36149 - protein, 5 aa, Artificial Sequence
  Description of Artificial Sequence: Synthetic peptide
  XENP022858 vhCDR1
GYGVN

SEQ ID NO: 36150 - protein, 16 aa, Artificial Sequence
  Description of Artificial Sequence: Synthetic peptide
  XENP022858 vhCDR2
MIWIDGSTDYNSKFQG

SEQ ID NO: 36151 - protein, 10 aa, Artificial Sequence
  Description of Artificial Sequence: Synthetic peptide
  XENP022858 vhCDR3
DRPDGRAMDY

SEQ ID NO: 36152 - protein, 480 aa, Artificial Sequence; identical to SEQ ID NO: 23581
  Description of Artificial Sequence: Synthetic polypeptide
  XENP022858 9C6_H1.1_L1_Fab-1G6_L1.194_H1.279_scFv scFv-Fc Heavy Chain

SEQ ID NO: 36153 - protein, 107 aa, Artificial Sequence; identical to SEQ ID NO: 10999
  Description of Artificial Sequence: Synthetic polypeptide
  VH of XENP022858

SEQ ID NO: 36154 - protein, 122 aa, Artificial Sequence; identical to SEQ ID NO: 10908
  Description of Artificial Sequence: Synthetic polypeptide
  VL of XENP022858

SEQ ID NO: 36155 - protein, 231 aa, Artificial Sequence; identical to SEQ ID NO: 21572
  Description of Artificial Sequence: Synthetic polypeptide
  Fc chain of XENP022858

SEQ ID NO: 36156 - protein, 11 aa, Artificial Sequence
  Description of Artificial Sequence: Synthetic peptide
  XENP022858 vhCDR1
RASQSVGNDVA

SEQ ID NO: 36157 - protein, 7 aa, Artificial Sequence
  Description of Artificial Sequence: Synthetic peptide
  XENP022858 vhCDR2
YASHRYT

SEQ ID NO: 36158 - protein, 9 aa, Artificial Sequence
  Description of Artificial Sequence: Synthetic peptide
  XENP022858 vhCDR3
QQDFSSPRT

SEQ ID NO: 36159 - protein, 5 aa, Artificial Sequence
  Description of Artificial Sequence: Synthetic peptide
  XENP022858 vlCDR1
NYWMN

SEQ ID NO: 36160 - protein, 19 aa, Artificial Sequence
  Description of Artificial Sequence: Synthetic peptide
  XENP022858 vlCDR2
EIRLYSNNYATHYAESVKG

SEQ ID NO: 36161 - protein, 11 aa, Artificial Sequence
  Description of Artificial Sequence: Synthetic peptide
  XENP022858 vlCDR3
YYGNYGGYFDV

SEQ ID NO: 36162 - protein, 213 aa, Artificial Sequence; identical to SEQ ID NO: 21050
  Description of Artificial Sequence: Synthetic polypeptide
  XENP022858 9C6_H1.1_L1_Fab-1G6_L1.194_H1.279_scFv Light Chain

SEQ ID NO: 36163 - protein, 106 aa, Artificial Sequence; identical to SEQ ID NO: 21051
  Description of Artificial Sequence: Synthetic polypeptide
  VL of XENP022858

SEQ ID NO: 36164 - protein, 11 aa, Artificial Sequence
  Description of Artificial Sequence: Synthetic peptide
  XENP022858 vlCDR1
KASQSVSNDVA

SEQ ID NO: 36165 - protein, 7 aa, Artificial Sequence
  Description of Artificial Sequence: Synthetic peptide
  XENP022858 vlCDR2
YASNRYT

SEQ ID NO: 36166 - protein, 8 aa, Artificial Sequence
  Description of Artificial Sequence: Synthetic peptide
  XENP022858 vlCDR3
QQDYSSPT

SEQ ID NO: 36167 - protein, 446 aa, Artificial Sequence
  Description of Artificial Sequence: Synthetic polypeptide
  XENP022726 1C11_H1L3_Fab-[CTLA-4]_H3.23_L0.129_scFv Fab-Fc Heavy Chain
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36168 - protein, 117 aa, Artificial Sequence; identical to SEQ ID NO: 33004
  Description of Artificial Sequence: Synthetic polypeptide
  VH of XENP022726

SEQ ID NO: 36169 - protein, 5 aa, Artificial Sequence
  Description of Artificial Sequence: Synthetic peptide
  XENP022726 vhCDR1
HYGMN

SEQ ID NO: 36170 - protein, 17 aa, Artificial Sequence
  Description of Artificial Sequence: Synthetic peptide
  XENP022726 vhCDR2
WINTYTGEPTYADKFQG

SEQ ID NO: 36171 - protein, 8 aa, Artificial Sequence
  Description of Artificial Sequence: Synthetic peptide
  XENP022726 vhCDR3
DYYGSSPY

SEQ ID NO: 36172 - protein, 477 aa, Artificial Sequence; identical to SEQ ID NO: 21669
  Description of Artificial Sequence: Synthetic polypeptide
  XENP022726 1C11_H1L3_Fab-[CTLA-4]_H3.23_L0.129_scFv scFv-Fc Heavy Chain

SEQ ID NO: 36173 - protein, 118 aa, Artificial Sequence; identical to SEQ ID NO: 2632
  Description of Artificial Sequence: Synthetic polypeptide
  VH of XENP022726

SEQ ID NO: 36174 - protein, 108 aa, Artificial Sequence; identical to SEQ ID NO: 2768
  Description of Artificial Sequence: Synthetic polypeptide
  VL of XENP022726

SEQ ID NO: 36175 - protein, 231 aa, Artificial Sequence; identical to SEQ ID NO: 21532
  Description of Artificial Sequence: Synthetic polypeptide
  Fc chain of XENP022726

SEQ ID NO: 36176 - protein, 5 aa, Artificial Sequence
  Description of Artificial Sequence: Synthetic peptide
  XENP022726 vhCDR1
SYTMH

SEQ ID NO: 36177 - protein, 17 aa, Artificial Sequence
  Description of Artificial Sequence: Synthetic peptide
  XENP022726 vhCDR2
FISYDGNYKYYADSVKG

SEQ ID NO: 36178 - protein, 9 aa, Artificial Sequence
  Description of Artificial Sequence: Synthetic peptide
  XENP022726 vhCDR3
GGHLGPFDL

SEQ ID NO: 36179 - protein, 12 aa, Artificial Sequence
  Description of Artificial Sequence: Synthetic peptide
  XENP022726 vlCDR1
RASQSVGSSYLA

SEQ ID NO: 36180 - protein, 7 aa, Artificial Sequence
  Description of Artificial Sequence: Synthetic peptide
  XENP022726 vlCDR2
GASSRAT

SEQ ID NO: 36181 - protein, 9 aa, Artificial Sequence
  Description of Artificial Sequence: Synthetic peptide
  XENP022726 vlCDR3
QQYGSSPWT

SEQ ID NO: 36182 - protein, 219 aa, Artificial Sequence; identical to SEQ ID NO: 33008
  Description of Artificial Sequence: Synthetic polypeptide
  XENP022726 1C11_H1L3_Fab-[CTLA-4]_H3.23_L0.129_scFv Light Chain

SEQ ID NO: 36183 - protein, 112 aa, Artificial Sequence; identical to SEQ ID NO: 33009
  Description of Artificial Sequence: Synthetic polypeptide
  VL of XENP022726

SEQ ID NO: 36184 - protein, 16 aa, Artificial Sequence
  Description of Artificial Sequence: Synthetic peptide
  XENP022726 vlCDR1
KSSQSIVHSNGNTYLE

SEQ ID NO: 36185 - protein, 7 aa, Artificial Sequence
  Description of Artificial Sequence: Synthetic peptide
  XENP022726 vlCDR2
KVSNRFS

SEQ ID NO: 36186 - protein, 9 aa, Artificial Sequence
  Description of Artificial Sequence: Synthetic peptide
  XENP022726 vlCDR3
FQGSHVPNT

SEQ ID NO: 36187 - protein, 446 aa, Artificial Sequence
  Description of Artificial Sequence: Synthetic polypeptide
  XENP022727 1C11_H2L1_Fab-[CTLA-4]_H3.23_L0.129_scFv Fab-Fc Heavy Chain
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36188 - protein, 117 aa, Artificial Sequence; identical to SEQ ID NO: 33014
  Description of Artificial Sequence: Synthetic polypeptide
  VH of XENP022727

SEQ ID NO: 36189 - protein, 5 aa, Artificial Sequence
  Description of Artificial Sequence: Synthetic peptide
  XENP022727 vhCDR1
HYGMN

SEQ ID NO: 36190 - protein, 17 aa, Artificial Sequence
  Description of Artificial Sequence: Synthetic peptide
  XENP022727 vhCDR2
WINTYTGEPTYADSVKG

SEQ ID NO: 36191 - protein, 8 aa, Artificial Sequence
  Description of Artificial Sequence: Synthetic peptide
  XENP022727 vhCDR3
DYYGSSPY

SEQ ID NO: 36192 - protein, 477 aa, Artificial Sequence; identical to SEQ ID NO: 21669
  Description of Artificial Sequence: Synthetic polypeptide
  XENP022727 1C11_H2L1_Fab-[CTLA-4]_H3.23_L0.129_scFv scFv-Fc Heavy Chain

SEQ ID NO: 36193 - protein, 118 aa, Artificial Sequence; identical to SEQ ID NO: 2632
  Description of Artificial Sequence: Synthetic polypeptide
  VH of XENP022727

SEQ ID NO: 36194 - protein, 108 aa, Artificial Sequence; identical to SEQ ID NO: 2768
  Description of Artificial Sequence: Synthetic polypeptide
  VL of XENP022727

SEQ ID NO: 36195 - protein, 231 aa, Artificial Sequence; identical to SEQ ID NO: 21532
  Description of Artificial Sequence: Synthetic polypeptide
  Fc chain of XENP022727

SEQ ID NO: 36196 - protein, 5 aa, Artificial Sequence
  Description of Artificial Sequence: Synthetic peptide
  XENP022727 vhCDR1
SYTMH

SEQ ID NO: 36197 - protein, 17 aa, Artificial Sequence
  Description of Artificial Sequence: Synthetic peptide
  XENP022727 vhCDR2
FISYDGNYKYYADSVKG

SEQ ID NO: 36198 - protein, 9 aa, Artificial Sequence
  Description of Artificial Sequence: Synthetic peptide
  XENP022727 vhCDR3
GGHLGPFDL

SEQ ID NO: 36199 - protein, 12 aa, Artificial Sequence
  Description of Artificial Sequence: Synthetic peptide
  XENP022727 vlCDR1
RASQSVGSSYLA

SEQ ID NO: 36200 - protein, 7 aa, Artificial Sequence
  Description of Artificial Sequence: Synthetic peptide
  XENP022727 vlCDR2
GASSRAT

SEQ ID NO: 36201 - protein, 9 aa, Artificial Sequence
  Description of Artificial Sequence: Synthetic peptide
  XENP022727 vlCDR3
QQYGSSPWT

SEQ ID NO: 36202 - protein, 219 aa, Artificial Sequence; identical to SEQ ID NO: 33018
  Description of Artificial Sequence: Synthetic polypeptide
  XENP022727 1C11_H2L1_Fab-[CTLA-4]_H3.23_L0.129_scFv Light Chain

SEQ ID NO: 36203 - protein, 112 aa, Artificial Sequence; identical to SEQ ID NO: 33019
  Description of Artificial Sequence: Synthetic polypeptide
  VL of XENP022727

SEQ ID NO: 36204 - protein, 16 aa, Artificial Sequence
  Description of Artificial Sequence: Synthetic peptide
  XENP022727 vlCDR1
RSSQSIVHSNGNTYLE

SEQ ID NO: 36205 - protein, 7 aa, Artificial Sequence
  Description of Artificial Sequence: Synthetic peptide
  XENP022727 vlCDR2
KVSNRFS

SEQ ID NO: 36206 - protein, 9 aa, Artificial Sequence
  Description of Artificial Sequence: Synthetic peptide
  XENP022727 vlCDR3
FQGSHVPNT

SEQ ID NO: 36207 - protein, 446 aa, Artificial Sequence; identical to SEQ ID NO: 36187
  Description of Artificial Sequence: Synthetic polypeptide
  XENP022728 1C11_H2L2_Fab-[CTLA-4]_H3.23_L0.129_scFv Fab-Fc Heavy Chain

SEQ ID NO: 36208 - protein, 117 aa, Artificial Sequence; identical to SEQ ID NO: 33014
  Description of Artificial Sequence: Synthetic polypeptide
  VH of XENP022728

SEQ ID NO: 36209 - protein, 5 aa, Artificial Sequence
  Description of Artificial Sequence: Synthetic peptide
  XENP022728 vhCDR1
HYGMN

SEQ ID NO: 36210 - protein, 17 aa, Artificial Sequence
  Description of Artificial Sequence: Synthetic peptide
  XENP022728 vhCDR2
WINTYTGEPTYADSVKG

SEQ ID NO: 36211 - protein, 8 aa, Artificial Sequence
  Description of Artificial Sequence: Synthetic peptide
  XENP022728 vhCDR3
DYYGSSPY

SEQ ID NO: 36212 - protein, 477 aa, Artificial Sequence; identical to SEQ ID NO: 21669
  Description of Artificial Sequence: Synthetic polypeptide
  XENP022728 1C11_H2L2_Fab-[CTLA-4]_H3.23_L0.129_scFv scFv-Fc Heavy Chain

SEQ ID NO: 36213 - protein, 118 aa, Artificial Sequence; identical to SEQ ID NO: 2632
  Description of Artificial Sequence: Synthetic polypeptide
  VH of XENP022728

SEQ ID NO: 36214 - protein, 108 aa, Artificial Sequence; identical to SEQ ID NO: 2768
  Description of Artificial Sequence: Synthetic polypeptide
  VL of XENP022728

SEQ ID NO: 36215 - protein, 231 aa, Artificial Sequence; identical to SEQ ID NO: 21532
  Description of Artificial Sequence: Synthetic polypeptide
  Fc chain of XENP022728

SEQ ID NO: 36216 - protein, 5 aa, Artificial Sequence
  Description of Artificial Sequence: Synthetic peptide
  XENP022728 vhCDR1
SYTMH

SEQ ID NO: 36217 - protein, 17 aa, Artificial Sequence
  Description of Artificial Sequence: Synthetic peptide
  XENP022728 vhCDR2
FISYDGNYKYYADSVKG

SEQ ID NO: 36218 - protein, 9 aa, Artificial Sequence
  Description of Artificial Sequence: Synthetic peptide
  XENP022728 vhCDR3
GGHLGPFDL

SEQ ID NO: 36219 - protein, 12 aa, Artificial Sequence
  Description of Artificial Sequence: Synthetic peptide
  XENP022728 vlCDR1
RASQSVGSSYLA

SEQ ID NO: 36220 - protein, 7 aa, Artificial Sequence
  Description of Artificial Sequence: Synthetic peptide
  XENP022728 vlCDR2
GASSRAT

SEQ ID NO: 36221 - protein, 9 aa, Artificial Sequence
  Description of Artificial Sequence: Synthetic peptide
  XENP022728 vlCDR3
QQYGSSPWT

SEQ ID NO: 36222 - protein, 219 aa, Artificial Sequence; identical to SEQ ID NO: 33028
  Description of Artificial Sequence: Synthetic polypeptide
  XENP022728 1C11_H2L2_Fab-[CTLA-4]_H3.23_L0.129_scFv Light Chain

SEQ ID NO: 36223 - protein, 112 aa, Artificial Sequence; identical to SEQ ID NO: 33029
  Description of Artificial Sequence: Synthetic polypeptide
  VL of XENP022728

SEQ ID NO: 36224 - protein, 16 aa, Artificial Sequence
  Description of Artificial Sequence: Synthetic peptide
  XENP022728 vlCDR1
RSSQSIVHSNGNTYLE

SEQ ID NO: 36225 - protein, 7 aa, Artificial Sequence
  Description of Artificial Sequence: Synthetic peptide
  XENP022728 vlCDR2
KVSNRFS

SEQ ID NO: 36226 - protein, 9 aa, Artificial Sequence
  Description of Artificial Sequence: Synthetic peptide
  XENP022728 vlCDR3
FQGSHVPNT

SEQ ID NO: 36227 - protein, 446 aa, Artificial Sequence
  Description of Artificial Sequence: Synthetic polypeptide
  XENP022729 1C11_H3L3_Fab-[CTLA-4]_H3.23_L0.129_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36228 - protein, 117 aa, Artificial Sequence; identical to SEQ ID NO: 33034
  Description of Artificial Sequence: Synthetic polypeptide
  VH of XENP022729

SEQ ID NO: 36229 - protein, 5 aa, Artificial Sequence
  Description of Artificial Sequence: Synthetic peptide
  XENP022729 vhCDR1
HYGMN

SEQ ID NO: 36230 - protein, 17 aa, Artificial Sequence
  Description of Artificial Sequence: Synthetic peptide
  XENP022729 vhCDR2
WINTYTGEPTYADGFTG

SEQ ID NO: 36231 - protein, 8 aa, Artificial Sequence
  Description of Artificial Sequence: Synthetic peptide
  XENP022729 vhCDR3
DYYGSSPY

SEQ ID NO: 36232 - protein, 477 aa, Artificial Sequence; identical to SEQ ID NO: 21669
  Description of Artificial Sequence: Synthetic polypeptide
  XENP022729 1C11_H3L3_Fab-[CTLA-4]_H3.23_L0.129_scFv scFv-Fc Heavy Chain

SEQ ID NO: 36233 - protein, 118 aa, Artificial Sequence; identical to SEQ ID NO: 2632
  Description of Artificial Sequence: Synthetic polypeptide
  VH of XENP022729

SEQ ID NO: 36234 - protein, 108 aa, Artificial Sequence; identical to SEQ ID NO: 2768
  Description of Artificial Sequence: Synthetic polypeptide
  VL of XENP022729

SEQ ID NO: 36235 - protein, 231 aa, Artificial Sequence; identical to SEQ ID NO: 21532
  Description of Artificial Sequence: Synthetic polypeptide
  Fc chain of XENP022729

SEQ ID NO: 36236 - protein, 5 aa, Artificial Sequence
  Description of Artificial Sequence: Synthetic peptide
  XENP022729 vhCDR1
SYTMH

SEQ ID NO: 36237 - protein, 17 aa, Artificial Sequence
  Description of Artificial Sequence: Synthetic peptide
  XENP022729 vhCDR2
FISYDGNYKYYADSVKG

SEQ ID NO: 36238 - protein, 9 aa, Artificial Sequence
  Description of Artificial Sequence: Synthetic peptide
  XENP022729 vhCDR3
GGHLGPFDL

SEQ ID NO: 36239 - protein, 12 aa, Artificial Sequence
  Description of Artificial Sequence: Synthetic peptide
  XENP022729 vlCDR1
RASQSVGSSYLA

SEQ ID NO: 36240 - protein, 7 aa, Artificial Sequence
  Description of Artificial Sequence: Synthetic peptide
  XENP022729 vlCDR2
GASSRAT

SEQ ID NO: 36241 - protein, 9 aa, Artificial Sequence
  Description of Artificial Sequence: Synthetic peptide
  XENP022729 vlCDR3
QQYGSSPWT

SEQ ID NO: 36242 - protein, 219 aa, Artificial Sequence; identical to SEQ ID NO: 33008
  Description of Artificial Sequence: Synthetic polypeptide
  XENP022729 1C11_H3L3_Fab-[CTLA-4]_H3.23_L0.129_scFv Light Chain

SEQ ID NO: 36243 - protein, 112 aa, Artificial Sequence; identical to SEQ ID NO: 33009
  Description of Artificial Sequence: Synthetic polypeptide
  VL of XENP022729

SEQ ID NO: 36244 - protein, 16 aa, Artificial Sequence
  Description of Artificial Sequence: Synthetic peptide
  XENP022729 vlCDR1
KSSQSIVHSNGNTYLE

SEQ ID NO: 36245 - protein, 7 aa, Artificial Sequence
  Description of Artificial Sequence: Synthetic peptide
  XENP022729 vlCDR2
KVSNRFS

SEQ ID NO: 36246 - protein, 9 aa, Artificial Sequence
  Description of Artificial Sequence: Synthetic peptide
  XENP022729 vlCDR3
FQGSHVPNT

SEQ ID NO: 36247 - protein, 449 aa, Artificial Sequence
  Description of Artificial Sequence: Synthetic polypeptide
  XENP022836 2E9_H1L1_Fab-[CTLA-4]_H3.23_L0.129_scFv HC-Fab
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36248 - protein, 120 aa, Artificial Sequence; identical to SEQ ID NO: 11412
  Description of Artificial Sequence: Synthetic polypeptide
  VH of XENP022836

SEQ ID NO: 36249 - protein, 5 aa, Artificial Sequence
  Description of Artificial Sequence: Synthetic peptide
  XENP022836 vhCDR1
NYWLG

SEQ ID NO: 36250 - protein, 17 aa, Artificial Sequence
  Description of Artificial Sequence: Synthetic peptide
  XENP022836 vhCDR2
NFYPGSSNTYYNEKFQG

SEQ ID NO: 36251 - protein, 11 aa, Artificial Sequence
  Description of Artificial Sequence: Synthetic peptide
  XENP022836 vhCDR3
HYGTNYRYFDV

SEQ ID NO: 36252 - protein, 477 aa, Artificial Sequence; identical to SEQ ID NO: 21669
  Description of Artificial Sequence: Synthetic polypeptide
  XENP022836 2E9_H1L1_Fab-[CTLA-4]_H3.23_L0.129_scFv HC-scFV

SEQ ID NO: 36253 - protein, 118 aa, Artificial Sequence; identical to SEQ ID NO: 2632
  Description of Artificial Sequence: Synthetic polypeptide
  VH of XENP022836

SEQ ID NO: 36254 - protein, 108 aa, Artificial Sequence; identical to SEQ ID NO: 2768
  Description of Artificial Sequence: Synthetic polypeptide
  VL of XENP022836

SEQ ID NO: 36255 - protein, 231 aa, Artificial Sequence; identical to SEQ ID NO: 21532
  Description of Artificial Sequence: Synthetic polypeptide
  Fc chain of XENP022836

SEQ ID NO: 36256 - protein, 5 aa, Artificial Sequence
  Description of Artificial Sequence: Synthetic peptide
  XENP022836 vhCDR1
SYTMH

SEQ ID NO: 36257 - protein, 17 aa, Artificial Sequence
  Description of Artificial Sequence: Synthetic peptide
  XENP022836 vhCDR2
FISYDGNYKYYADSVKG

SEQ ID NO: 36258 - protein, 9 aa, Artificial Sequence
  Description of Artificial Sequence: Synthetic peptide
  XENP022836 vhCDR3
GGHLGPFDL

SEQ ID NO: 36259 - protein, 12 aa, Artificial Sequence
  Description of Artificial Sequence: Synthetic peptide
  XENP022836 vlCDR1
RASQSVGSSYLA

SEQ ID NO: 36260 - protein, 7 aa, Artificial Sequence
  Description of Artificial Sequence: Synthetic peptide
  XENP022836 vlCDR2
GASSRAT

SEQ ID NO: 36261 - protein, 9 aa, Artificial Sequence
  Description of Artificial Sequence: Synthetic peptide
  XENP022836 vlCDR3
QQYGSSPWT

SEQ ID NO: 36262 - protein, 214 aa, Artificial Sequence; identical to SEQ ID NO: 17080
  Description of Artificial Sequence: Synthetic polypeptide
  XENP022836 2E9_H1L1_Fab-[CTLA-4]_H3.23_L0.129_scFv Light Chain

SEQ ID NO: 36263 - protein, 107 aa, Artificial Sequence; identical to SEQ ID NO: 11413
  Description of Artificial Sequence: Synthetic polypeptide
  VL of XENP022836

SEQ ID NO: 36264 - protein, 11 aa, Artificial Sequence
  Description of Artificial Sequence: Synthetic peptide
  XENP022836 vlCDR1
RASQSVSNDVA

SEQ ID NO: 36265 - protein, 7 aa, Artificial Sequence
  Description of Artificial Sequence: Synthetic peptide
  XENP022836 vlCDR2
YASNRYT

SEQ ID NO: 36266 - protein, 9 aa, Artificial Sequence
  Description of Artificial Sequence: Synthetic peptide
  XENP022836 vlCDR3
QQDYSSPYT

SEQ ID NO: 36267 - protein, 446 aa, Artificial Sequence
  Description of Artificial Sequence: Synthetic polypeptide
  XENP022854 1C11_H3L3_Fab-[CTLA-4]_H3.23_L0.129_[CTLA-4]_scFv Fab-Fc Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36268 - protein, 117 aa, Artificial Sequence; identical to SEQ ID NO: 33034
  Description of Artificial Sequence: Synthetic polypeptide
  VH of XENP022854

SEQ ID NO: 36269 - protein, 5 aa, Artificial Sequence
  Description of Artificial Sequence: Synthetic peptide
  XENP022854 vhCDR1
HYGMN

SEQ ID NO: 36270 - protein, 17 aa, Artificial Sequence
  Description of Artificial Sequence: Synthetic peptide
  XENP022854 vhCDR2
WINTYTGEPTYADGFTG

SEQ ID NO: 36271 - protein, 8 aa, Artificial Sequence
  Description of Artificial Sequence: Synthetic peptide
  XENP022854 vhCDR3
DYYGSSPY

SEQ ID NO: 36272 - protein, 477 aa, Artificial Sequence; identical to SEQ ID NO: 35612
  Description of Artificial Sequence: Synthetic polypeptide
  XENP022854 1C11_H3L3_Fab-[CTLA-4]_H3.23_L0.129_[CTLA-4]_scFv scFv-Fc Heavy Chain

SEQ ID NO: 36273 - protein, 118 aa, Artificial Sequence; identical to SEQ ID NO: 2632
  Description of Artificial Sequence: Synthetic polypeptide
  VH of XENP022854

SEQ ID NO: 36274 - protein, 108 aa, Artificial Sequence; identical to SEQ ID NO: 2768
  Description of Artificial Sequence: Synthetic polypeptide
  VL of XENP022854

SEQ ID NO: 36275 - protein, 231 aa, Artificial Sequence; identical to SEQ ID NO: 21572
  Description of Artificial Sequence: Synthetic polypeptide
  Fc chain of XENP022854

SEQ ID NO: 36276 - protein, 5 aa, Artificial Sequence
  Description of Artificial Sequence: Synthetic peptide
  XENP022854 vhCDR1
SYTMH

SEQ ID NO: 36277 - protein, 17 aa, Artificial Sequence
  Description of Artificial Sequence: Synthetic peptide
  XENP022854 vhCDR2
FISYDGNYKYYADSVKG

SEQ ID NO: 36278 - protein, 9 aa, Artificial Sequence
  Description of Artificial Sequence: Synthetic peptide
  XENP022854 vhCDR3
GGHLGPFDL

SEQ ID NO: 36279 - protein, 12 aa, Artificial Sequence
  Description of Artificial Sequence: Synthetic peptide
  XENP022854 vlCDR1
RASQSVGSSYLA

SEQ ID NO: 36280 - protein, 7 aa, Artificial Sequence
  Description of Artificial Sequence: Synthetic peptide
  XENP022854 vlCDR2
GASSRAT

SEQ ID NO: 36281 - protein, 9 aa, Artificial Sequence
  Description of Artificial Sequence: Synthetic peptide
  XENP022854 vlCDR3
QQYGSSPWT

SEQ ID NO: 36282 - protein, 219 aa, Artificial Sequence; identical to SEQ ID NO: 33008
  Description of Artificial Sequence: Synthetic polypeptide
  XENP022854 1C11_H3L3_Fab-[CTLA-4]_H3.23_L0.129_[CTLA-4]_scFv Light Chain

SEQ ID NO: 36283 - protein, 112 aa, Artificial Sequence; identical to SEQ ID NO: 33009
  Description of Artificial Sequence: Synthetic polypeptide
  VL of XENP022854

SEQ ID NO: 36284 - protein, 16 aa, Artificial Sequence
  Description of Artificial Sequence: Synthetic peptide
  XENP022854 vlCDR1
KSSQSIVHSNGNTYLE

SEQ ID NO: 36285 - protein, 7 aa, Artificial Sequence
  Description of Artificial Sequence: Synthetic peptide
  XENP022854 vlCDR2
KVSNRFS

SEQ ID NO: 36286 - protein, 9 aa, Artificial Sequence
  Description of Artificial Sequence: Synthetic peptide
  XENP022854 vlCDR3
FQGSHVPNT

SEQ ID NO: 36287 - protein, 449 aa, Artificial Sequence
  Description of Artificial Sequence: Synthetic polypeptide
  XENP022855 2E9_H1L1_Fab-[CTLA-4]_H3.23_L0.129_[CTLA-4]_scFv Fab-Fc Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 36288 - protein, 120 aa, Artificial Sequence; identical to SEQ ID NO: 11412
  Description of Artificial Sequence: Synthetic polypeptide
  VH of XENP022855

SEQ ID NO: 36289 - protein, 5 aa, Artificial Sequence
  Description of Artificial Sequence: Synthetic peptide
  XENP022855 vhCDR1
NYWLG

SEQ ID NO: 36290 - protein, 17 aa, Artificial Sequence
  Description of Artificial Sequence: Synthetic peptide
  XENP022855 vhCDR2
NFYPGSSNTYYNEKFQG

SEQ ID NO: 36291 - protein, 11 aa, Artificial Sequence
  Description of Artificial Sequence: Synthetic peptide
  XENP022855 vhCDR3
HYGTNYRYFDV

SEQ ID NO: 36292 - protein, 477 aa, Artificial Sequence; identical to SEQ ID NO: 35612
  Description of Artificial Sequence: Synthetic polypeptide
  XENP022855 2E9_H1L1_Fab-[CTLA-4]_H3.23_L0.129_[CTLA-4]_scFv scFv-Fc Heavy Chain

SEQ ID NO: 36293 - protein, 118 aa, Artificial Sequence; identical to SEQ ID NO: 2632
  Description of Artificial Sequence: Synthetic polypeptide
  VH of XENP022855

SEQ ID NO: 36294 - protein, 108 aa, Artificial Sequence; identical to SEQ ID NO: 2768
  Description of Artificial Sequence: Synthetic polypeptide
  VL of XENP022855

SEQ ID NO: 36295 - protein, 231 aa, Artificial Sequence; identical to SEQ ID NO: 21572
  Description of Artificial Sequence: Synthetic polypeptide
  Fc chain of XENP022855

SEQ ID NO: 36296 - protein, 5 aa, Artificial Sequence
  Description of Artificial Sequence: Synthetic peptide
  XENP022855 vhCDR1
SYTMH

SEQ ID NO: 36297 - protein, 17 aa, Artificial Sequence
  Description of Artificial Sequence: Synthetic peptide
  XENP022855 vhCDR2
FISYDGNYKYYADSVKG

SEQ ID NO: 36298 - protein, 9 aa, Artificial Sequence
  Description of Artificial Sequence: Synthetic peptide
  XENP022855 vhCDR3
GGHLGPFDL

SEQ ID NO: 36299 - protein, 12 aa, Artificial Sequence
  Description of Artificial Sequence: Synthetic peptide
  XENP022855 vlCDR1
RASQSVGSSYLA

SEQ ID NO: 36300 - protein, 7 aa, Artificial Sequence
  Description of Artificial Sequence: Synthetic peptide
  XENP022855 vlCDR2
GASSRAT

SEQ ID NO: 36301 - protein, 9 aa, Artificial Sequence
  Description of Artificial Sequence: Synthetic peptide
  XENP022855 vlCDR3
QQYGSSPWT

SEQ ID NO: 36302 - protein, 214 aa, Artificial Sequence; identical to SEQ ID NO: 17080
  Description of Artificial Sequence: Synthetic polypeptide
  XENP022855 2E9_H1L1_Fab-[CTLA-4]_H3.23_L0.129_[CTLA-4]_scFv Light Chain

SEQ ID NO: 36303 - protein, 107 aa, Artificial Sequence; identical to SEQ ID NO: 11413
  Description of Artificial Sequence: Synthetic polypeptide
  VL of XENP022855

SEQ ID NO: 36304 - protein, 11 aa, Artificial Sequence
  Description of Artificial Sequence: Synthetic peptide
  XENP022855 vlCDR1
RASQSVSNDVA

SEQ ID NO: 36305 - protein, 7 aa, Artificial Sequence
  Description of Artificial Sequence: Synthetic peptide
  XENP022855 vlCDR2
YASNRYT

SEQ ID NO: 36306 - protein, 9 aa, Artificial Sequence
  Description of Artificial Sequence: Synthetic peptide
  XENP022855 vlCDR3
QQDYSSPYT

SEQ ID NO: 36307 - protein, 446 aa, Artificial Sequence; identical to SEQ ID NO: 36227
  Description of Artificial Sequence: Synthetic polypeptide
  XENP022993 1C11_H3L1_Fab-[CTLA-4]_H3.23_L0.129_scFv Fab-Fc Heavy Chain

SEQ ID NO: 36308 - protein, 117 aa, Artificial Sequence; identical to SEQ ID NO: 33034
  Description of Artificial Sequence: Synthetic polypeptide
  VH of XENP022993

SEQ ID NO: 36309 - protein, 5 aa, Artificial Sequence
  Description of Artificial Sequence: Synthetic peptide
  XENP022993 vhCDR1
HYGMN

SEQ ID NO: 36310 - protein, 17 aa, Artificial Sequence
  Description of Artificial Sequence: Synthetic peptide
  XENP022993 vhCDR2
WINTYTGEPTYADGFTG

SEQ ID NO: 36311 - protein, 8 aa, Artificial Sequence
  Description of Artificial Sequence: Synthetic peptide
  XENP022993 vhCDR3
DYYGSSPY

SEQ ID NO: 36312 - protein, 477 aa, Artificial Sequence; identical to SEQ ID NO: 21669
  Description of Artificial Sequence: Synthetic polypeptide
  XENP022993 1C11_H3L1_Fab-[CTLA-4]_H3.23_L0.129_scFv scFv-Fc Heavy Chain

SEQ ID NO: 36313 - protein, 118 aa, Artificial Sequence; identical to SEQ ID NO: 2632
  Description of Artificial Sequence: Synthetic polypeptide
  VH of XENP022993

SEQ ID NO: 36314 - protein, 108 aa, Artificial Sequence; identical to SEQ ID NO: 2768
  Description of Artificial Sequence: Synthetic polypeptide
  VL of XENP022993

SEQ ID NO: 36315 - protein, 231 aa, Artificial Sequence; identical to SEQ ID NO: 21532
  Description of Artificial Sequence: Synthetic polypeptide
  Fc chain of XENP022993

SEQ ID NO: 36316 - protein, 5 aa, Artificial Sequence
  Description of Artificial Sequence: Synthetic peptide
  XENP022993 vhCDR1
SYTMH

SEQ ID NO: 36317 - protein, 17 aa, Artificial Sequence
  Description of Artificial Sequence: Synthetic peptide
  XENP022993 vhCDR2
FISYDGNYKYYADSVKG

SEQ ID NO: 36318 - protein, 9 aa, Artificial Sequence
  Description of Artificial Sequence: Synthetic peptide
  XENP022993 vhCDR3
GGHLGPFDL

SEQ ID NO: 36319 - protein, 12 aa, Artificial Sequence
  Description of Artificial Sequence: Synthetic peptide
  XENP022993 vlCDR1
RASQSVGSSYLA

SEQ ID NO: 36320 - protein, 7 aa, Artificial Sequence
  Description of Artificial Sequence: Synthetic peptide
  XENP022993 vlCDR2
GASSRAT

SEQ ID NO: 36321 - protein, 9 aa, Artificial Sequence
  Description of Artificial Sequence: Synthetic peptide
  XENP022993 vlCDR3
QQYGSSPWT

SEQ ID NO: 36322 - protein, 219 aa, Artificial Sequence; identical to SEQ ID NO: 33018
  Description of Artificial Sequence: Synthetic polypeptide
  XENP022993 1C11_H3L1_Fab-[CTLA-4]_H3.23_L0.129_scFv Light Chain

SEQ ID NO: 36323 - protein, 112 aa, Artificial Sequence; identical to SEQ ID NO: 33019
  Description of Artificial Sequence: Synthetic polypeptide
  VL of XENP022993

SEQ ID NO: 36324 - protein, 16 aa, Artificial Sequence
  Description of Artificial Sequence: Synthetic peptide
  XENP022993 vlCDR1
RSSQSIVHSNGNTYLE

SEQ ID NO: 36325 - protein, 7 aa, Artificial Sequence
  Description of Artificial Sequence: Synthetic peptide
  XENP022993 vlCDR2
KVSNRFS

SEQ ID NO: 36326 - protein, 9 aa, Artificial Sequence
  Description of Artificial Sequence: Synthetic peptide
  XENP022993 vlCDR3
FQGSHVPNT

SEQ ID NO: 36327 - protein, 446 aa, Artificial Sequence; identical to SEQ ID NO: 36227
  Description of Artificial Sequence: Synthetic polypeptide
  XENP022994 1C11_H3L2_Fab-[CTLA-4]_H3.23_L0.129_scFv Fab-Fc Heavy Chain

SEQ ID NO: 36328 - protein, 117 aa, Artificial Sequence; identical to SEQ ID NO: 33034
  Description of Artificial Sequence: Synthetic polypeptide
  VH of XENP022994

SEQ ID NO: 36329 - protein, 5 aa, Artificial Sequence
  Description of Artificial Sequence: Synthetic peptide
  XENP022994 vhCDR1
HYGMN

SEQ ID NO: 36330 - protein, 17 aa, Artificial Sequence
  Description of Artificial Sequence: Synthetic peptide
  XENP022994 vhCDR2
WINTYTGEPTYADGFTG

SEQ ID NO: 36331 - protein, 8 aa, Artificial Sequence
  Description of Artificial Sequence: Synthetic peptide
  XENP022994 vhCDR3
DYYGSSPY

SEQ ID NO: 36332 - protein, 477 aa, Artificial Sequence; identical to SEQ ID NO: 21669
  Description of Artificial Sequence: Synthetic polypeptide
  XENP022994 1C11_H3L2_Fab-[CTLA-4]_H3.23_L0.129_scFv scFv-Fc Heavy Chain

SEQ ID NO: 36333 - protein, 118 aa, Artificial Sequence; identical to SEQ ID NO: 2632
  Description of Artificial Sequence: Synthetic polypeptide
  VH of XENP022994

SEQ ID NO: 36334 - protein, 108 aa, Artificial Sequence; identical to SEQ ID NO: 2768
  Description of Artificial Sequence: Synthetic polypeptide
  VL of XENP022994

SEQ ID NO: 36335 - protein, 231 aa, Artificial Sequence; identical to SEQ ID NO: 21532
  Description of Artificial Sequence: Synthetic polypeptide
  Fc chain of XENP022994

SEQ ID NO: 36336 - protein, 5 aa, Artificial Sequence
  Description of Artificial Sequence: Synthetic peptide
  XENP022994 vhCDR1
SYTMH

SEQ ID NO: 36337 - protein, 17 aa, Artificial Sequence
  Description of Artificial Sequence: Synthetic peptide
  XENP022994 vhCDR2
FISYDGNYKYYADSVKG

SEQ ID NO: 36338 - protein, 9 aa, Artificial Sequence
  Description of Artificial Sequence: Synthetic peptide
  XENP022994 vhCDR3
GGHLGPFDL

SEQ ID NO: 36339 - protein, 12 aa, Artificial Sequence
  Description of Artificial Sequence: Synthetic peptide
  XENP022994 vlCDR1
RASQSVGSSYLA

SEQ ID NO: 36340 - protein, 7 aa, Artificial Sequence
  Description of Artificial Sequence: Synthetic peptide
  XENP022994 vlCDR2
GASSRAT

SEQ ID NO: 36341 - protein, 9 aa, Artificial Sequence
  Description of Artificial Sequence: Synthetic peptide
  XENP022994 vlCDR3
QQYGSSPWT

SEQ ID NO: 36342 - protein, 219 aa, Artificial Sequence; identical to SEQ ID NO: 33028
  Description of Artificial Sequence: Synthetic polypeptide
  XENP022994 1C11_H3L2_Fab-[CTLA-4]_H3.23_L0.129_scFv Light Chain

SEQ ID NO: 36343 - protein, 112 aa, Artificial Sequence; identical to SEQ ID NO: 33029
  Description of Artificial Sequence: Synthetic polypeptide
  VL of XENP022994

SEQ ID NO: 36344 - protein, 16 aa, Artificial Sequence
  Description of Artificial Sequence: Synthetic peptide
  XENP022994 vlCDR1
RSSQSIVHSNGNTYLE

SEQ ID NO: 36345 - protein, 7 aa, Artificial Sequence
  Description of Artificial Sequence: Synthetic peptide
  XENP022994 vlCDR2
KVSNRFS

SEQ ID NO: 36346 - protein, 9 aa, Artificial Sequence
  Description of Artificial Sequence: Synthetic peptide
  XENP022994 vlCDR3
FQGSHVPNT

SEQ ID NO: 36347 - protein, 446 aa, Artificial Sequence
  Description of Artificial Sequence: Synthetic polypeptide
  XENP020850 1D12_H1L1_IgG1_PVA_/S267K Heavy Chain
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36348 - protein, 117 aa, Artificial Sequence
  Description of Artificial Sequence: Synthetic polypeptide
  VH of XENP020850
QVQLVQSGAEVKKPGASVKVSCKASGYTFTSYTMHWVRQAPGQGLEWMGYLIPSSGYTDYNQKFQGRVTMTADKSTSTAYMELSSLRSEDTAVYYCARGDSVYFDYWGQGTLVTVSS

SEQ ID NO: 36349 - protein, 5 aa, Artificial Sequence
  Description of Artificial Sequence: Synthetic peptide
  XENP020850 vhCDR1
SYTMH

SEQ ID NO: 36350 - protein, 17 aa, Artificial Sequence
  Description of Artificial Sequence: Synthetic peptide
  XENP020850 vhCDR2
YLIPSSGYTDYNQKFQG

SEQ ID NO: 36351 - protein, 8 aa, Artificial Sequence
  Description of Artificial Sequence: Synthetic peptide
  XENP020850 vhCDR3
GDSVYFDY

SEQ ID NO: 36352 - protein, 218 aa, Artificial Sequence
  Description of Artificial Sequence: Synthetic polypeptide
  XENP020850 1D12_H1L1_IgG1_PVA_/S267K Light Chain
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36353 - protein, 111 aa, Artificial Sequence
  Description of Artificial Sequence: Synthetic polypeptide
  VL of XENP020850
DIVLTQSPATLSLSPGERATLSCRASESVEYYGTSLMQWYQQKPGQPPRLLIYAASNVESGVPARFSGSGSGTDFTLTISSLEPEDFAVYFCQQSRKVPWTFGGGTKVEIK

SEQ ID NO: 36354 - protein, 15 aa, Artificial Sequence
  Description of Artificial Sequence: Synthetic peptide
  XENP020850 vlCDR1
RASESVEYYGTSLMQ

SEQ ID NO: 36355 - protein, 7 aa, Artificial Sequence
  Description of Artificial Sequence: Synthetic peptide
  XENP020850 vlCDR2
AASNVES

SEQ ID NO: 36356 - protein, 9 aa, Artificial Sequence
  Description of Artificial Sequence: Synthetic peptide
  XENP020850 vlCDR3
QQSRKVPWT

SEQ ID NO: 36357 - protein, 446 aa, Artificial Sequence; identical to SEQ ID NO: 36347
  Description of Artificial Sequence: Synthetic polypeptide
  XENP020851 1D12_H1L2_IgG1_PVA_/S267K Heavy Chain

SEQ ID NO: 36358 - protein, 117 aa, Artificial Sequence; identical to SEQ ID NO: 36348
  Description of Artificial Sequence: Synthetic polypeptide
  VH of XENP020851

SEQ ID NO: 36359 - protein, 5 aa, Artificial Sequence
  Description of Artificial Sequence: Synthetic peptide
  XENP020851 vhCDR1
SYTMH

SEQ ID NO: 36360 - protein, 17 aa, Artificial Sequence
  Description of Artificial Sequence: Synthetic peptide
  XENP020851 vhCDR2
YLIPSSGYTDYNQKFQG

SEQ ID NO: 36361 - protein, 8 aa, Artificial Sequence
  Description of Artificial Sequence: Synthetic peptide
  XENP020851 vhCDR3
GDSVYFDY

SEQ ID NO: 36362 - protein, 218 aa, Artificial Sequence
  Description of Artificial Sequence: Synthetic polypeptide
  XENP020851 1D12_H1L2_IgG1_PVA_/S267K Light Chain
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36363 - protein, 111 aa, Artificial Sequence
  Description of Artificial Sequence: Synthetic polypeptide
  VL of XENP020851
DIVLTQSPDSLAVSLGERATINCKASESVEYYGTSLMQWYQQKPGQPPKLLIYAASNVESGVPARFSGSGSGTDFTLTISSLQAEDVAVYFCQQSRKVPWTFGGGTKVEIK

SEQ ID NO: 36364 - protein, 15 aa, Artificial Sequence
  Description of Artificial Sequence: Synthetic peptide
  XENP020851 vlCDR1
KASESVEYYGTSLMQ

SEQ ID NO: 36365 - protein, 7 aa, Artificial Sequence
  Description of Artificial Sequence: Synthetic peptide
  XENP020851 vlCDR2
AASNVES

SEQ ID NO: 36366 - protein, 9 aa, Artificial Sequence
  Description of Artificial Sequence: Synthetic peptide
  XENP020851 vlCDR3
QQSRKVPWT

SEQ ID NO: 36367 - protein, 446 aa, Artificial Sequence
  Description of Artificial Sequence: Synthetic polypeptide
  XENP020853 3H3_H1L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36368 - protein, 117 aa, Artificial Sequence
  Description of Artificial Sequence: Synthetic polypeptide
  VH of XENP020853
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSS

SEQ ID NO: 36369 - protein, 5 aa, Artificial Sequence
  Description of Artificial Sequence: Synthetic peptide
  XENP020853 vhCDR1
GYGVN

SEQ ID NO: 36370 - protein, 16 aa, Artificial Sequence
  Description of Artificial Sequence: Synthetic peptide
  XENP020853 vhCDR2
MIWGDGSTDYNSALKS

SEQ ID NO: 36371 - protein, 9 aa, Artificial Sequence
  Description of Artificial Sequence: Synthetic peptide
  XENP020853 vhCDR3
SYYTSDEDY

SEQ ID NO: 36372 - protein, 219 aa, Artificial Sequence
  Description of Artificial Sequence: Synthetic polypeptide
  XENP020853 3H3_H1L1_IgG1_PVA_/S267K Light Chain
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36373 - protein, 112 aa, Artificial Sequence
  Description of Artificial Sequence: Synthetic polypeptide
  VL of XENP020853
DIVLTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 36374 - protein, 17 aa, Artificial Sequence
  Description of Artificial Sequence: Synthetic peptide
  XENP020853 vlCDR1
RSSQSLLNSRTRKNYLA

SEQ ID NO: 36375 - protein, 7 aa, Artificial Sequence
  Description of Artificial Sequence: Synthetic peptide
  XENP020853 vlCDR2
WASTRES

SEQ ID NO: 36376 - protein, 8 aa, Artificial Sequence
  Description of Artificial Sequence: Synthetic peptide
  XENP020853 vlCDR3
KQSYSLRT

SEQ ID NO: 36377 - protein, 446 aa, Artificial Sequence; identical to SEQ ID NO: 36367
  Description of Artificial Sequence: Synthetic polypeptide
  XENP020854 3H3_H1L2_IgG1_PVA_/S267K Heavy Chain

SEQ ID NO: 36378 - protein, 117 aa, Artificial Sequence; identical to SEQ ID NO: 36368
  Description of Artificial Sequence: Synthetic polypeptide
  VH of XENP020854

SEQ ID NO: 36379 - protein, 5 aa, Artificial Sequence
  Description of Artificial Sequence: Synthetic peptide
  XENP020854 vhCDR1
GYGVN

SEQ ID NO: 36380 - protein, 16 aa, Artificial Sequence
  Description of Artificial Sequence: Synthetic peptide
  XENP020854 vhCDR2
MIWGDGSTDYNSALKS

SEQ ID NO: 36381 - protein, 9 aa, Artificial Sequence
  Description of Artificial Sequence: Synthetic peptide
  XENP020854 vhCDR3
SYYTSDEDY

SEQ ID NO: 36382 - protein, 219 aa, Artificial Sequence
  Description of Artificial Sequence: Synthetic polypeptide
  XENP020854 3H3_H1L2_IgG1_PVA_/S267K Light Chain
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36383 - protein, 112 aa, Artificial Sequence
  Description of Artificial Sequence: Synthetic polypeptide
  VL of XENP020854
DIVLTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 36384 - protein, 17 aa, Artificial Sequence
  Description of Artificial Sequence: Synthetic peptide
  XENP020854 vlCDR1
KSSQSLLNSRTRKNYLA

SEQ ID NO: 36385 - protein, 7 aa, Artificial Sequence
  Description of Artificial Sequence: Synthetic peptide
  XENP020854 vlCDR2
WASTRES

SEQ ID NO: 36386 - protein, 8 aa, Artificial Sequence
  Description of Artificial Sequence: Synthetic peptide
  XENP020854 vlCDR3
KQSYSLRT

SEQ ID NO: 36387 - protein, 446 aa, Artificial Sequence
  Description of Artificial Sequence: Synthetic polypeptide
  XENP020855 3H3_H2L1_IgG1_PVA_/S267K Heavy Chain
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36388 - protein, 117 aa, Artificial Sequence
  Description of Artificial Sequence: Synthetic polypeptide
  VH of XENP020855
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDFDYWGQGTLVTVSS

SEQ ID NO: 36389 - protein, 5 aa, Artificial Sequence
  Description of Artificial Sequence: Synthetic peptide
  XENP020855 vhCDR1
GYGVN

SEQ ID NO: 36390 - protein, 16 aa, Artificial Sequence
  Description of Artificial Sequence: Synthetic peptide
  XENP020855 vhCDR2
MIWGDGSTDYNSALKS

SEQ ID NO: 36391 - protein, 9 aa, Artificial Sequence
  Description of Artificial Sequence: Synthetic peptide
  XENP020855 vhCDR3
SYYTSDFDY

SEQ ID NO: 36392 - protein, 219 aa, Artificial Sequence; identical to SEQ ID NO: 36372
  Description of Artificial Sequence: Synthetic polypeptide
  XENP020855 3H3_H2L1_IgG1_PVA_/S267K Light Chain

SEQ ID NO: 36393 - protein, 112 aa, Artificial Sequence; identical to SEQ ID NO: 36373
  Description of Artificial Sequence: Synthetic polypeptide
  VL of XENP020855

SEQ ID NO: 36394 - protein, 17 aa, Artificial Sequence
  Description of Artificial Sequence: Synthetic peptide
  XENP020855 vlCDR1
RSSQSLLNSRTRKNYLA

SEQ ID NO: 36395 - protein, 7 aa, Artificial Sequence
  Description of Artificial Sequence: Synthetic peptide
  XENP020855 vlCDR2
WASTRES

SEQ ID NO: 36396 - protein, 8 aa, Artificial Sequence
  Description of Artificial Sequence: Synthetic peptide
  XENP020855 vlCDR3
KQSYSLRT

SEQ ID NO: 36397 - protein, 446 aa, Artificial Sequence; identical to SEQ ID NO: 36387
  Description of Artificial Sequence: Synthetic polypeptide
  XENP020856 3H3_H2L2_IgG1_PVA_/S267K Heavy Chain

SEQ ID NO: 36398 - protein, 117 aa, Artificial Sequence; identical to SEQ ID NO: 36388
  Description of Artificial Sequence: Synthetic polypeptide
  VH of XENP020856

SEQ ID NO: 36399 - protein, 5 aa, Artificial Sequence
  Description of Artificial Sequence: Synthetic peptide
  XENP020856 vhCDR1
GYGVN

SEQ ID NO: 36400 - protein, 16 aa, Artificial Sequence
  Description of Artificial Sequence: Synthetic peptide
  XENP020856 vhCDR2
MIWGDGSTDYNSALKS

SEQ ID NO: 36401 - protein, 9 aa, Artificial Sequence
  Description of Artificial Sequence: Synthetic peptide
  XENP020856 vhCDR3
SYYTSDFDY

SEQ ID NO: 36402 - protein, 219 aa, Artificial Sequence; identical to SEQ ID NO: 36382
  Description of Artificial Sequence: Synthetic polypeptide
  XENP020856 3H3_H2L2_IgG1_PVA_/S267K Light Chain

SEQ ID NO: 36403 - protein, 112 aa, Artificial Sequence; identical to SEQ ID NO: 36383
  Description of Artificial Sequence: Synthetic polypeptide
  VL of XENP020856

SEQ ID NO: 36404 - protein, 17 aa, Artificial Sequence
  Description of Artificial Sequence: Synthetic peptide
  XENP020856 vlCDR1
KSSQSLLNSRTRKNYLA

SEQ ID NO: 36405 - protein, 7 aa, Artificial Sequence
  Description of Artificial Sequence: Synthetic peptide
  XENP020856 vlCDR2
WASTRES

SEQ ID NO: 36406 - protein, 8 aa, Artificial Sequence
  Description of Artificial Sequence: Synthetic peptide
  XENP020856 vlCDR3
KQSYSLRT

SEQ ID NO: 36407 - protein, 446 aa, Artificial Sequence
  Description of Artificial Sequence: Synthetic polypeptide
  XENP020857 3H3_H3L1_IgG1_PVA_/S267K Heavy Chain
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36408 - protein, 117 aa, Artificial Sequence
  Description of Artificial Sequence: Synthetic polypeptide
  VH of XENP020857
EVQLLESGGGLVQPGGSLRLSCAVSGFSLNGYGVNWVRQAPGKGLEWVSMIWGDGSTDYNSAVKGRFTISKDNSKSTVYLQMNSLRAEDTAVYYCARSYYTSDEDYWGQGTLVTVSS

SEQ ID NO: 36409 - protein, 5 aa, Artificial Sequence
  Description of Artificial Sequence: Synthetic peptide
  XENP020857 vhCDR1
GYGVN

SEQ ID NO: 36410 - protein, 16 aa, Artificial Sequence
  Description of Artificial Sequence: Synthetic peptide
  XENP020857 vhCDR2
MIWGDGSTDYNSAVKG

SEQ ID NO: 36411 - protein, 9 aa, Artificial Sequence
  Description of Artificial Sequence: Synthetic peptide
  XENP020857 vhCDR3
SYYTSDEDY

SEQ ID NO: 36412 - protein, 219 aa, Artificial Sequence; identical to SEQ ID NO: 36372
  Description of Artificial Sequence: Synthetic polypeptide
  XENP020857 3H3_H3L1_IgG1_PVA_/S267K Light Chain

SEQ ID NO: 36413 - protein, 112 aa, Artificial Sequence; identical to SEQ ID NO: 36373
  Description of Artificial Sequence: Synthetic polypeptide
  VL of XENP020857

SEQ ID NO: 36414 - protein, 17 aa, Artificial Sequence
  Description of Artificial Sequence: Synthetic peptide
  XENP020857 vlCDR1
RSSQSLLNSRTRKNYLA

SEQ ID NO: 36415 - protein, 7 aa, Artificial Sequence
  Description of Artificial Sequence: Synthetic peptide
  XENP020857 vlCDR2
WASTRES

SEQ ID NO: 36416 - protein, 8 aa, Artificial Sequence
  Description of Artificial Sequence: Synthetic peptide
  XENP020857 vlCDR3
KQSYSLRT

SEQ ID NO: 36417 - protein, 446 aa, Artificial Sequence; identical to SEQ ID NO: 36407
  Description of Artificial Sequence: Synthetic polypeptide
  XENP020858 3H3_H3L2_IgG1_PVA_/S267K Heavy Chain

SEQ ID NO: 36418 - protein, 117 aa, Artificial Sequence; identical to SEQ ID NO: 36408
  Description of Artificial Sequence: Synthetic polypeptide
  VH of XENP020858

SEQ ID NO: 36419 - protein, 5 aa, Artificial Sequence
  Description of Artificial Sequence: Synthetic peptide
  XENP020858 vhCDR1
GYGVN

SEQ ID NO: 36420 - protein, 16 aa, Artificial Sequence
  Description of Artificial Sequence: Synthetic peptide
  XENP020858 vhCDR2
MIWGDGSTDYNSAVKG

SEQ ID NO: 36421 - protein, 9 aa, Artificial Sequence
  Description of Artificial Sequence: Synthetic peptide
  XENP020858 vhCDR3
SYYTSDEDY

SEQ ID NO: 36422 - protein, 219 aa, Artificial Sequence; identical to SEQ ID NO: 36382
  Description of Artificial Sequence: Synthetic polypeptide
  XENP020858 3H3_H3L2_IgG1_PVA_/S267K Light Chain

SEQ ID NO: 36423 - protein, 112 aa, Artificial Sequence; identical to SEQ ID NO: 36383
  Description of Artificial Sequence: Synthetic polypeptide
  VL of XENP020858

SEQ ID NO: 36424 - protein, 17 aa, Artificial Sequence
  Description of Artificial Sequence: Synthetic peptide
  XENP020858 vlCDR1
KSSQSLLNSRTRKNYLA

SEQ ID NO: 36425 - protein, 7 aa, Artificial Sequence
  Description of Artificial Sequence: Synthetic peptide
  XENP020858 vlCDR2
WASTRES

SEQ ID NO: 36426 - protein, 8 aa, Artificial Sequence
  Description of Artificial Sequence: Synthetic peptide
  XENP020858 vlCDR3
KQSYSLRT

SEQ ID NO: 36427 - protein, 446 aa, Artificial Sequence
  Description of Artificial Sequence: Synthetic polypeptide
  XENP020859 3H3_H4L1_IgG1_PVA_/S267K Heavy Chain
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36428 - protein, 117 aa, Artificial Sequence
  Description of Artificial Sequence: Synthetic polypeptide
  VH of XENP020859
QVQLQESGPGLVKPSETLSLTCTVSGFSLNGYGVNWVRQPPGKGLEWIGMIWGDGSTDYNPSLKSRVTISKDNSKSQVSLKLSSVTAADTAVYYCARSYYTSDEDYWGQGTLVTVSS

SEQ ID NO: 36429 - protein, 5 aa, Artificial Sequence
  Description of Artificial Sequence: Synthetic peptide
  XENP020859 vhCDR1
GYGVN

SEQ ID NO: 36430 - protein, 16 aa, Artificial Sequence
  Description of Artificial Sequence: Synthetic peptide
  XENP020859 vhCDR2
MIWGDGSTDYNPSLKS

SEQ ID NO: 36431 - protein, 9 aa, Artificial Sequence
  Description of Artificial Sequence: Synthetic peptide
  XENP020859 vhCDR3
SYYTSDEDY

SEQ ID NO: 36432 - protein, 219 aa, Artificial Sequence; identical to SEQ ID NO: 36372
  Description of Artificial Sequence: Synthetic polypeptide
  XENP020859 3H3_H4L1_IgG1_PVA_/S267K Light Chain

SEQ ID NO: 36433 - protein, 112 aa, Artificial Sequence; identical to SEQ ID NO: 36373
  Description of Artificial Sequence: Synthetic polypeptide
  VL of XENP020859

SEQ ID NO: 36434 - protein, 17 aa, Artificial Sequence
  Description of Artificial Sequence: Synthetic peptide
  XENP020859 vlCDR1
RSSQSLLNSRTRKNYLA

SEQ ID NO: 36435 - protein, 7 aa, Artificial Sequence
  Description of Artificial Sequence: Synthetic peptide
  XENP020859 vlCDR2
WASTRES

SEQ ID NO: 36436 - protein, 8 aa, Artificial Sequence
  Description of Artificial Sequence: Synthetic peptide
  XENP020859 vlCDR3
KQSYSLRT

SEQ ID NO: 36437 - protein, 446 aa, Artificial Sequence; identical to SEQ ID NO: 36427
  Description of Artificial Sequence: Synthetic polypeptide
  XENP020860 3H3_H4L2_IgG1_PVA_/S267K Heavy Chain

SEQ ID NO: 36438 - protein, 117 aa, Artificial Sequence; identical to SEQ ID NO: 36428
  Description of Artificial Sequence: Synthetic polypeptide
  VH of XENP020860

SEQ ID NO: 36439 - protein, 5 aa, Artificial Sequence
  Description of Artificial Sequence: Synthetic peptide
  XENP020860 vhCDR1
GYGVN

SEQ ID NO: 36440 - protein, 16 aa, Artificial Sequence
  Description of Artificial Sequence: Synthetic peptide
  XENP020860 vhCDR2
MIWGDGSTDYNPSLKS

SEQ ID NO: 36441 - protein, 9 aa, Artificial Sequence
  Description of Artificial Sequence: Synthetic peptide
  XENP020860 vhCDR3
SYYTSDEDY

SEQ ID NO: 36442 - protein, 219 aa, Artificial Sequence; identical to SEQ ID NO: 36382
  Description of Artificial Sequence: Synthetic polypeptide
  XENP020860 3H3_H4L2_IgG1_PVA_/S267K Light Chain

SEQ ID NO: 36443 - protein, 112 aa, Artificial Sequence; identical to SEQ ID NO: 36383
  Description of Artificial Sequence: Synthetic polypeptide
  VL of XENP020860

SEQ ID NO: 36444 - protein, 17 aa, Artificial Sequence
  Description of Artificial Sequence: Synthetic peptide
  XENP020860 vlCDR1
KSSQSLLNSRTRKNYLA

SEQ ID NO: 36445 - protein, 7 aa, Artificial Sequence
  Description of Artificial Sequence: Synthetic peptide
  XENP020860 vlCDR2
WASTRES

SEQ ID NO: 36446 - protein, 8 aa, Artificial Sequence
  Description of Artificial Sequence: Synthetic peptide
  XENP020860 vlCDR3
KQSYSLRT

SEQ ID NO: 36447 - protein, 447 aa, Artificial Sequence
  Description of Artificial Sequence: Synthetic polypeptide
  XENP020861 7B11_H1L1_IgG1_PVA_/S267K Heavy Chain
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36448 - protein, 118 aa, Artificial Sequence
  Description of Artificial Sequence: Synthetic polypeptide
  VH of XENP020861
QVQLVQSGAEVKKPGASVKVSCKVSGFSLTSYAVNWVRQAPGQGLEWMGVIWSGGSTDYNAKFQGRVTMTKDNSKSTVYMELSSLRSEDTAVYYCVSLYYRYDGFDYWGQGTLVTVSS

SEQ ID NO: 36449 - protein, 5 aa, Artificial Sequence
  Description of Artificial Sequence: Synthetic peptide
  XENP020861 vhCDR1
SYAVN

SEQ ID NO: 36450 - protein, 16 aa, Artificial Sequence
  Description of Artificial Sequence: Synthetic peptide
  XENP020861 vhCDR2
VIWSGGSTDYNAKFQG

SEQ ID NO: 36451 - protein, 10 aa, Artificial Sequence
  Description of Artificial Sequence: Synthetic peptide
  XENP020861 vhCDR3
LYYRYDGFDY

SEQ ID NO: 36452 - protein, 214 aa, Artificial Sequence
  Description of Artificial Sequence: Synthetic polypeptide
  XENP020861 7B11_H1L1_IgG1_PVA_/S267K Light Chain
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36453 - protein, 107 aa, Artificial Sequence
  Description of Artificial Sequence: Synthetic polypeptide
  VL of XENP020861
DIVLTQSPSSLSASVGDRVTITCRASQNVGTHVARYQQKPGKSPKALVYSASYRYSGVPDRFTGSGSGTDFTLTISSLQPEDFATYFCQQYNSYPLTFGGGTKVEIK

SEQ ID NO: 36454 - protein, 11 aa, Artificial Sequence
  Description of Artificial Sequence: Synthetic peptide
  XENP020861 vlCDR1
RASQNVGTHVA

SEQ ID NO: 36455 - protein, 7 aa, Artificial Sequence
  Description of Artificial Sequence: Synthetic peptide
  XENP020861 vlCDR2
SASYRYS

SEQ ID NO: 36456 - protein, 9 aa, Artificial Sequence
  Description of Artificial Sequence: Synthetic peptide
  XENP020861 vlCDR3
QQYNSYPLT

SEQ ID NO: 36457 - protein, 447 aa, Artificial Sequence; identical to SEQ ID NO: 36447
  Description of Artificial Sequence: Synthetic polypeptide
  XENP020862 7B11_H1L2_IgG1_PVA_/S267K Heavy Chain

SEQ ID NO: 36458 - protein, 118 aa, Artificial Sequence; identical to SEQ ID NO: 36448
  Description of Artificial Sequence: Synthetic polypeptide
  VH of XENP020862

SEQ ID NO: 36459 - protein, 5 aa, Artificial Sequence
  Description of Artificial Sequence: Synthetic peptide
  XENP020862 vhCDR1
SYAVN

SEQ ID NO: 36460 - protein, 16 aa, Artificial Sequence
  Description of Artificial Sequence: Synthetic peptide
  XENP020862 vhCDR2
VIWSGGSTDYNAKFQG

SEQ ID NO: 36461 - protein, 10 aa, Artificial Sequence
  Description of Artificial Sequence: Synthetic peptide
  XENP020862 vhCDR3
LYYRYDGFDY

SEQ ID NO: 36462 - protein, 214 aa, Artificial Sequence
  Description of Artificial Sequence: Synthetic polypeptide
  XENP020862 7B11_H1L2_IgG1_PVA_/S267K Light Chain
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36463 - protein, 107 aa, Artificial Sequence
  Description of Artificial Sequence: Synthetic polypeptide
  VL of XENP020862
DIVLTQSPDSLAVSLGERATINCKASQNVGTHVARYQQKPGQSPKALVYSASYRYSGVPDRFTGSGSGTDFTLTISSLQAEDVAVYFCQQYNSYPLTFGGGTKVEIK

SEQ ID NO: 36464 - protein, 11 aa, Artificial Sequence
  Description of Artificial Sequence: Synthetic peptide
  XENP020862 vlCDR1
KASQNVGTHVA

SEQ ID NO: 36465 - protein, 7 aa, Artificial Sequence
  Description of Artificial Sequence: Synthetic peptide
  XENP020862 vlCDR2
SASYRYS

SEQ ID NO: 36466 - protein, 9 aa, Artificial Sequence
  Description of Artificial Sequence: Synthetic peptide
  XENP020862 vlCDR3
QQYNSYPLT

SEQ ID NO: 36467 - protein, 447 aa, Artificial Sequence
  Description of Artificial Sequence: Synthetic polypeptide
  XENP020863 7B11_H2L1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36468 - protein, 118 aa, Artificial Sequence
  Description of Artificial Sequence: Synthetic polypeptide
  VH of XENP020863
EVQLVESGGGLVQPGGSLRLSCAVSGFSLTSYAVNWVRQAPGKGLEWVSVIWSGGSTDYNPSVKGRFTISKDNSKSTVYLQLNSLRAEDTAVYYCVSLYYRYDGFDYWGQGTLVTVSS

SEQ ID NO: 36469 - protein, 5 aa, Artificial Sequence
  Description of Artificial Sequence: Synthetic peptide
  XENP020863 vhCDR1
SYAVN

SEQ ID NO: 36470 - protein, 16 aa, Artificial Sequence
  Description of Artificial Sequence: Synthetic peptide
  XENP020863 vhCDR2
VIWSGGSTDYNPSVKG

SEQ ID NO: 36471 - protein, 10 aa, Artificial Sequence
  Description of Artificial Sequence: Synthetic peptide
  XENP020863 vhCDR3
LYYRYDGFDY

SEQ ID NO: 36472 - protein, 214 aa, Artificial Sequence; identical to SEQ ID NO: 36452
  Description of Artificial Sequence: Synthetic polypeptide
  XENP020863 7B11_H2L1_IgG1_PVA_/S267K Light Chain

SEQ ID NO: 36473 - protein, 107 aa, Artificial Sequence; identical to SEQ ID NO: 36453
  Description of Artificial Sequence: Synthetic polypeptide
  VL of XENP020863

SEQ ID NO: 36474 - protein, 11 aa, Artificial Sequence
  Description of Artificial Sequence: Synthetic peptide
  XENP020863 vlCDR1
RASQNVGTHVA

SEQ ID NO: 36475 - protein, 7 aa, Artificial Sequence
  Description of Artificial Sequence: Synthetic peptide
  XENP020863 vlCDR2
SASYRYS

SEQ ID NO: 36476 - protein, 9 aa, Artificial Sequence
  Description of Artificial Sequence: Synthetic peptide
  XENP020863 vlCDR3
QQYNSYPLT

SEQ ID NO: 36477 - protein, 447 aa, Artificial Sequence; identical to SEQ ID NO: 36467
  Description of Artificial Sequence: Synthetic polypeptide
  XENP020864 7B11_H2L2_IgG1_PVA_/S267K Heavy Chain

SEQ ID NO: 36478 - protein, 118 aa, Artificial Sequence; identical to SEQ ID NO: 36468
  Description of Artificial Sequence: Synthetic polypeptide
  VH of XENP020864

SEQ ID NO: 36479 - protein, 5 aa, Artificial Sequence
  Description of Artificial Sequence: Synthetic peptide
  XENP020864 vhCDR1
SYAVN

SEQ ID NO: 36480 - protein, 16 aa, Artificial Sequence
  Description of Artificial Sequence: Synthetic peptide
  XENP020864 vhCDR2
VIWSGGSTDYNPSVKG

SEQ ID NO: 36481 - protein, 10 aa, Artificial Sequence
  Description of Artificial Sequence: Synthetic peptide
  XENP020864 vhCDR3
LYYRYDGFDY

SEQ ID NO: 36482 - protein, 214 aa, Artificial Sequence; identical to SEQ ID NO: 36462
  Description of Artificial Sequence: Synthetic polypeptide
  XENP020864 7B11_H2L2_IgG1_PVA_/S267K Light Chain

SEQ ID NO: 36483 - protein, 107 aa, Artificial Sequence; identical to SEQ ID NO: 36463
  Description of Artificial Sequence: Synthetic polypeptide
  VL of XENP020864

SEQ ID NO: 36484 - protein, 11 aa, Artificial Sequence
  Description of Artificial Sequence: Synthetic peptide
  XENP020864 vlCDR1
KASQNVGTHVA

SEQ ID NO: 36485 - protein, 7 aa, Artificial Sequence
  Description of Artificial Sequence: Synthetic peptide
  XENP020864 vlCDR2
SASYRYS

SEQ ID NO: 36486 - protein, 9 aa, Artificial Sequence
  Description of Artificial Sequence: Synthetic peptide
  XENP020864 vlCDR3
QQYNSYPLT

SEQ ID NO: 36487 - protein, 446 aa, Artificial Sequence
  Description of Artificial Sequence: Synthetic polypeptide
  XENP020865 7C2_H1L1_IgG1_PVA_/S267K Heavy Chain
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36488 - protein, 117 aa, Artificial Sequence
  Description of Artificial Sequence: Synthetic polypeptide
  VH of XENP020865
EVQVLESGGGLVQPGGSLRLSCAASGFTFSRYAVSWVRQAPGKRLEWVSSISSGGSTYYPDSVKGRFTISRDNSKNTLYLQLNSLRAEDTAVYYCARGDYEGYFDYWGQGTLVTVSS

SEQ ID NO: 36489 - protein, 5 aa, Artificial Sequence
  Description of Artificial Sequence: Synthetic peptide
  XENP020865 vhCDR1
RYAVS

SEQ ID NO: 36490 - protein, 16 aa, Artificial Sequence
  Description of Artificial Sequence: Synthetic peptide
  XENP020865 vhCDR2
SISSGGSTYYPDSVKG

SEQ ID NO: 36491 - protein, 9 aa, Artificial Sequence
  Description of Artificial Sequence: Synthetic peptide
  XENP020865 vhCDR3
GDYEGYFDY

SEQ ID NO: 36492 - protein, 220 aa, Artificial Sequence
  Description of Artificial Sequence: Synthetic polypeptide
  XENP020865 7C2_H1L1_IgG1_PVA_/S267K Light Chain
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36493 - protein, 113 aa, Artificial Sequence
  Description of Artificial Sequence: Synthetic polypeptide
  VL of XENP020865
DIVLTQSPDSLAVSLGERATINCKSSQSLLNSINQKNYLAGYQQKPGQSPKLLVYFASTRESGVPDRFIGSGSGTDFTLTISSLQAEDVAVYFCQQHYSTPLTFGAGTKLEIK

SEQ ID NO: 36494 - protein, 17 aa, Artificial Sequence
  Description of Artificial Sequence: Synthetic peptide
  XENP020865 vlCDR1
KSSQSLLNSINQKNYLA

SEQ ID NO: 36495 - protein, 7 aa, Artificial Sequence
  Description of Artificial Sequence: Synthetic peptide
  XENP020865 vlCDR2
FASTRES

SEQ ID NO: 36496 - protein, 9 aa, Artificial Sequence
  Description of Artificial Sequence: Synthetic peptide
  XENP020865 vlCDR3
QQHYSTPLT

SEQ ID NO: 36497 - protein, 446 aa, Artificial Sequence; identical to SEQ ID NO: 36367
  Description of Artificial Sequence: Synthetic polypeptide
  XENP021188 3H3_H1_L1.1_IgG1_PVA_/S267K Heavy Chain

SEQ ID NO: 36498 - protein, 117 aa, Artificial Sequence; identical to SEQ ID NO: 36368
  Description of Artificial Sequence: Synthetic polypeptide
  VH of XENP021188

SEQ ID NO: 36499 - protein, 5 aa, Artificial Sequence
  Description of Artificial Sequence: Synthetic peptide
  XENP021188 vhCDR1
GYGVN

SEQ ID NO: 36500 - protein, 16 aa, Artificial Sequence
  Description of Artificial Sequence: Synthetic peptide
  XENP021188 vhCDR2
MIWGDGSTDYNSALKS

SEQ ID NO: 36501 - protein, 9 aa, Artificial Sequence
  Description of Artificial Sequence: Synthetic peptide
  XENP021188 vhCDR3
SYYTSDEDY

SEQ ID NO: 36502 - protein, 219 aa, Artificial Sequence
  Description of Artificial Sequence: Synthetic polypeptide
  XENP021188 3H3_H1_L1.1_IgG1_PVA_/S267K Light Chain
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36503 - protein, 112 aa, Artificial Sequence
  Description of Artificial Sequence: Synthetic polypeptide
  VL of XENP021188
DIVMTQTPLSLPVTPGEPASISCRSSQSLLNSRTRKNYLAWYLQKPGQSPQLLIYWASTRESGVPDRFTGSGSGTDFTLKISRVEAEDVGVYYCKQSYSLRTFGGGTKVEIK

SEQ ID NO: 36504 - protein, 17 aa, Artificial Sequence
  Description of Artificial Sequence: Synthetic peptide
  XENP021188 vlCDR1
RSSQSLLNSRTRKNYLA

SEQ ID NO: 36505 - protein, 7 aa, Artificial Sequence
  Description of Artificial Sequence: Synthetic peptide
  XENP021188 vlCDR2
WASTRES

SEQ ID NO: 36506 - protein, 8 aa, Artificial Sequence
  Description of Artificial Sequence: Synthetic peptide
  XENP021188 vlCDR3
KQSYSLRT

SEQ ID NO: 36507 - protein, 446 aa, Artificial Sequence; identical to SEQ ID NO: 36367
  Description of Artificial Sequence: Synthetic polypeptide
  XENP021189 3H3_H1_L2.1_IgG1_PVA_/S267K Heavy Chain

SEQ ID NO: 36508 - protein, 117 aa, Artificial Sequence; identical to SEQ ID NO: 36368
  Description of Artificial Sequence: Synthetic polypeptide
  VH of XENP021189

SEQ ID NO: 36509 - protein, 5 aa, Artificial Sequence
  Description of Artificial Sequence: Synthetic peptide
  XENP021189 vhCDR1
GYGVN

SEQ ID NO: 36510 - protein, 16 aa, Artificial Sequence
  Description of Artificial Sequence: Synthetic peptide
  XENP021189 vhCDR2
MIWGDGSTDYNSALKS

SEQ ID NO: 36511 - protein, 9 aa, Artificial Sequence
  Description of Artificial Sequence: Synthetic peptide
  XENP021189 vhCDR3
SYYTSDEDY

SEQ ID NO: 36512 - protein, 219 aa, Artificial Sequence
  Description of Artificial Sequence: Synthetic polypeptide
  XENP021189 3H3_H1_L2.1_IgG1_PVA_/S267K Light Chain
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36513 - protein, 112 aa, Artificial Sequence
  Description of Artificial Sequence: Synthetic polypeptide
  VL of XENP021189
DIVMTQSPDSLAVSLGERATINCKSSQSLLNSRTRKNYLAWYQQKPGQSPKLLIYWASTRESGVPDRFTGSGSGTDFTLTISSLQAEDVAVYYCKQSYSLRTFGGGTKVEIK

SEQ ID NO: 36514 - protein, 17 aa, Artificial Sequence
  Description of Artificial Sequence: Synthetic peptide
  XENP021189 vlCDR1
KSSQSLLNSRTRKNYLA

SEQ ID NO: 36515 - protein, 7 aa, Artificial Sequence
  Description of Artificial Sequence: Synthetic peptide
  XENP021189 vlCDR2
WASTRES

SEQ ID NO: 36516 - protein, 8 aa, Artificial Sequence
  Description of Artificial Sequence: Synthetic peptide
  XENP021189 vlCDR3
KQSYSLRT

SEQ ID NO: 36517 - protein, 446 aa, Artificial Sequence; identical to SEQ ID NO: 36387
  Description of Artificial Sequence: Synthetic polypeptide
  XENP021190 3H3_H2_L1.1_IgG1_PVA_/S267K Heavy Chain

SEQ ID NO: 36518 - protein, 117 aa, Artificial Sequence; identical to SEQ ID NO: 36388
  Description of Artificial Sequence: Synthetic polypeptide
  VH of XENP021190

SEQ ID NO: 36519 - protein, 5 aa, Artificial Sequence
  Description of Artificial Sequence: Synthetic peptide
  XENP021190 vhCDR1
GYGVN

SEQ ID NO: 36520 - protein, 16 aa, Artificial Sequence
  Description of Artificial Sequence: Synthetic peptide
  XENP021190 vhCDR2
MIWGDGSTDYNSALKS

SEQ ID NO: 36521 - protein, 9 aa, Artificial Sequence
  Description of Artificial Sequence: Synthetic peptide
  XENP021190 vhCDR3
SYYTSDFDY

SEQ ID NO: 36522 - protein, 219 aa, Artificial Sequence; identical to SEQ ID NO: 36502
  Description of Artificial Sequence: Synthetic polypeptide
  XENP021190 3H3_H2_L1.1_IgG1_PVA_/S267K Light Chain

SEQ ID NO: 36523 - protein, 112 aa, Artificial Sequence; identical to SEQ ID NO: 36503
  Description of Artificial Sequence: Synthetic polypeptide
  VL of XENP021190

SEQ ID NO: 36524 - protein, 17 aa, Artificial Sequence
  Description of Artificial Sequence: Synthetic peptide
  XENP021190 vlCDR1
RSSQSLLNSRTRKNYLA

SEQ ID NO: 36525 - protein, 7 aa, Artificial Sequence
  Description of Artificial Sequence: Synthetic peptide
  XENP021190 vlCDR2
WASTRES

SEQ ID NO: 36526 - protein, 8 aa, Artificial Sequence
  Description of Artificial Sequence: Synthetic peptide
  XENP021190 vlCDR3
KQSYSLRT

SEQ ID NO: 36527 - protein, 446 aa, Artificial Sequence; identical to SEQ ID NO: 36387
  Description of Artificial Sequence: Synthetic polypeptide
  XENP021191 3H3_H2_L2.1_IgG1_PVA_/S267K Heavy Chain

SEQ ID NO: 36528 - protein, 117 aa, Artificial Sequence; identical to SEQ ID NO: 36388
  Description of Artificial Sequence: Synthetic polypeptide
  VH of XENP021191

SEQ ID NO: 36529 - protein, 5 aa, Artificial Sequence
  Description of Artificial Sequence: Synthetic peptide
  XENP021191 vhCDR1
GYGVN

SEQ ID NO: 36530 - protein, 16 aa, Artificial Sequence
  Description of Artificial Sequence: Synthetic peptide
  XENP021191 vhCDR2
MIWGDGSTDYNSALKS

SEQ ID NO: 36531 - protein, 9 aa, Artificial Sequence
  Description of Artificial Sequence: Synthetic peptide
  XENP021191 vhCDR3
SYYTSDFDY

SEQ ID NO: 36532 - protein, 219 aa, Artificial Sequence; identical to SEQ ID NO: 36512
  Description of Artificial Sequence: Synthetic polypeptide
  XENP021191 3H3_H2_L2.1_IgG1_PVA_/S267K Light Chain

SEQ ID NO: 36533 - protein, 112 aa, Artificial Sequence; identical to SEQ ID NO: 36513
  Description of Artificial Sequence: Synthetic polypeptide
  VL of XENP021191

SEQ ID NO: 36534 - protein, 17 aa, Artificial Sequence
  Description of Artificial Sequence: Synthetic peptide
  XENP021191 vlCDR1
KSSQSLLNSRTRKNYLA

SEQ ID NO: 36535 - protein, 7 aa, Artificial Sequence
  Description of Artificial Sequence: Synthetic peptide
  XENP021191 vlCDR2
WASTRES

SEQ ID NO: 36536 - protein, 8 aa, Artificial Sequence
  Description of Artificial Sequence: Synthetic peptide
  XENP021191 vlCDR3
KQSYSLRT

SEQ ID NO: 36537 - protein, 446 aa, Artificial Sequence; identical to SEQ ID NO: 36407
  Description of Artificial Sequence: Synthetic polypeptide
  XENP021192 3H3_H3_L1.1_IgG1_PVA_/S267K Heavy Chain

SEQ ID NO: 36538 - protein, 117 aa, Artificial Sequence; identical to SEQ ID NO: 36408
  Description of Artificial Sequence: Synthetic polypeptide
  VH of XENP021192

SEQ ID NO: 36539 - protein, 5 aa, Artificial Sequence
  Description of Artificial Sequence: Synthetic peptide
  XENP021192 vhCDR1
GYGVN

SEQ ID NO: 36540 - protein, 16 aa, Artificial Sequence
  Description of Artificial Sequence: Synthetic peptide
  XENP021192 vhCDR2
MIWGDGSTDYNSAVKG

SEQ ID NO: 36541 - protein, 9 aa, Artificial Sequence
  Description of Artificial Sequence: Synthetic peptide
  XENP021192 vhCDR3
SYYTSDEDY

SEQ ID NO: 36542 - protein, 219 aa, Artificial Sequence; identical to SEQ ID NO: 36502
  Description of Artificial Sequence: Synthetic polypeptide
  XENP021192 3H3_H3_L1.1_IgG1_PVA_/S267K Light Chain

SEQ ID NO: 36543 - protein, 112 aa, Artificial Sequence; identical to SEQ ID NO: 36503
  Description of Artificial Sequence: Synthetic polypeptide
  VL of XENP021192

SEQ ID NO: 36544 - protein, 17 aa, Artificial Sequence
  Description of Artificial Sequence: Synthetic peptide
  XENP021192 vlCDR1
RSSQSLLNSRTRKNYLA

SEQ ID NO: 36545 - protein, 7 aa, Artificial Sequence
  Description of Artificial Sequence: Synthetic peptide
  XENP021192 vlCDR2
WASTRES

SEQ ID NO: 36546 - protein, 8 aa, Artificial Sequence
  Description of Artificial Sequence: Synthetic peptide
  XENP021192 vlCDR3
KQSYSLRT

SEQ ID NO: 36547 - protein, 446 aa, Artificial Sequence; identical to SEQ ID NO: 36407
  Description of Artificial Sequence: Synthetic polypeptide
  XENP021193 3H3_H3_L2.1_IgG1_PVA_/S267K Heavy Chain

SEQ ID NO: 36548 - protein, 117 aa, Artificial Sequence; identical to SEQ ID NO: 36408
  Description of Artificial Sequence: Synthetic polypeptide
  VH of XENP021193

SEQ ID NO: 36549 - protein, 5 aa, Artificial Sequence
  Description of Artificial Sequence: Synthetic peptide
  XENP021193 vhCDR1
GYGVN

SEQ ID NO: 36550 - protein, 16 aa, Artificial Sequence
  Description of Artificial Sequence: Synthetic peptide
  XENP021193 vhCDR2
MIWGDGSTDYNSAVKG

SEQ ID NO: 36551 - protein, 9 aa, Artificial Sequence
  Description of Artificial Sequence: Synthetic peptide
  XENP021193 vhCDR3
SYYTSDEDY

SEQ ID NO: 36552 - protein, 219 aa, Artificial Sequence; identical to SEQ ID NO: 36512
  Description of Artificial Sequence: Synthetic polypeptide
  XENP021193 3H3_H3_L2.1_IgG1_PVA_/S267K Light Chain

SEQ ID NO: 36553 - protein, 112 aa, Artificial Sequence; identical to SEQ ID NO: 36513
  Description of Artificial Sequence: Synthetic polypeptide
  VL of XENP021193

SEQ ID NO: 36554 - protein, 17 aa, Artificial Sequence
  Description of Artificial Sequence: Synthetic peptide
  XENP021193 vlCDR1
KSSQSLLNSRTRKNYLA

SEQ ID NO: 36555 - protein, 7 aa, Artificial Sequence
  Description of Artificial Sequence: Synthetic peptide
  XENP021193 vlCDR2
WASTRES

SEQ ID NO: 36556 - protein, 8 aa, Artificial Sequence
  Description of Artificial Sequence: Synthetic peptide
  XENP021193 vlCDR3
KQSYSLRT

SEQ ID NO: 36557 - protein, 446 aa, Artificial Sequence; identical to SEQ ID NO: 36427
  Description of Artificial Sequence: Synthetic polypeptide
  XENP021194 3H3_H4_L1.1_IgG1_PVA_/S267K Heavy Chain

SEQ ID NO: 36558 - protein, 117 aa, Artificial Sequence; identical to SEQ ID NO: 36428
  Description of Artificial Sequence: Synthetic polypeptide
  VH of XENP021194

SEQ ID NO: 36559 - protein, 5 aa, Artificial Sequence
  Description of Artificial Sequence: Synthetic peptide
  XENP021194 vhCDR1
GYGVN

SEQ ID NO: 36560 - protein, 16 aa, Artificial Sequence
  Description of Artificial Sequence: Synthetic peptide
  XENP021194 vhCDR2
MIWGDGSTDYNPSLKS

SEQ ID NO: 36561 - protein, 9 aa, Artificial Sequence
  Description of Artificial Sequence: Synthetic peptide
  XENP021194 vhCDR3
SYYTSDEDY

SEQ ID NO: 36562 - protein, 219 aa, Artificial Sequence; identical to SEQ ID NO: 36502
  Description of Artificial Sequence: Synthetic polypeptide
  XENP021194 3H3_H4_L1.1_IgG1_PVA_/S267K Light Chain

SEQ ID NO: 36563 - protein, 112 aa, Artificial Sequence; identical to SEQ ID NO: 36503
  Description of Artificial Sequence: Synthetic polypeptide
  VL of XENP021194

SEQ ID NO: 36564 - protein, 17 aa, Artificial Sequence
  Description of Artificial Sequence: Synthetic peptide
  XENP021194 vlCDR1
RSSQSLLNSRTRKNYLA

SEQ ID NO: 36565 - protein, 7 aa, Artificial Sequence
  Description of Artificial Sequence: Synthetic peptide
  XENP021194 vlCDR2
WASTRES

SEQ ID NO: 36566 - protein, 8 aa, Artificial Sequence
  Description of Artificial Sequence: Synthetic peptide
  XENP021194 vlCDR3
KQSYSLRT

SEQ ID NO: 36567 - protein, 446 aa, Artificial Sequence; identical to SEQ ID NO: 36427
  Description of Artificial Sequence: Synthetic polypeptide
  XENP021195 3H3_H4_L2.1_IgG1_PVA_/S267K Heavy Chain

SEQ ID NO: 36568 - protein, 117 aa, Artificial Sequence; identical to SEQ ID NO: 36428
  Description of Artificial Sequence: Synthetic polypeptide
  VH of XENP021195

SEQ ID NO: 36569 - protein, 5 aa, Artificial Sequence
  Description of Artificial Sequence: Synthetic peptide
  XENP021195 vhCDR1
GYGVN

SEQ ID NO: 36570 - protein, 16 aa, Artificial Sequence
  Description of Artificial Sequence: Synthetic peptide
  XENP021195 vhCDR2
MIWGDGSTDYNPSLKS

SEQ ID NO: 36571 - protein, 9 aa, Artificial Sequence
  Description of Artificial Sequence: Synthetic peptide
  XENP021195 vhCDR3
SYYTSDEDY

SEQ ID NO: 36572 - protein, 219 aa, Artificial Sequence; identical to SEQ ID NO: 36512
  Description of Artificial Sequence: Synthetic polypeptide
  XENP021195 3H3_H4_L2.1_IgG1_PVA_/S267K Light Chain

SEQ ID NO: 36573 - protein, 112 aa, Artificial Sequence; identical to SEQ ID NO: 36513
  Description of Artificial Sequence: Synthetic polypeptide
  VL of XENP021195

SEQ ID NO: 36574 - protein, 17 aa, Artificial Sequence
  Description of Artificial Sequence: Synthetic peptide
  XENP021195 vlCDR1
KSSQSLLNSRTRKNYLA

SEQ ID NO: 36575 - protein, 7 aa, Artificial Sequence
  Description of Artificial Sequence: Synthetic peptide
  XENP021195 vlCDR2
WASTRES

SEQ ID NO: 36576 - protein, 8 aa, Artificial Sequence
  Description of Artificial Sequence: Synthetic peptide
  XENP021195 vlCDR3
KQSYSLRT

SEQ ID NO: 36577 - protein, 447 aa, Artificial Sequence; identical to SEQ ID NO: 36447
  Description of Artificial Sequence: Synthetic polypeptide
  XENP021196 7B11_H1_L1.1_IgG1_PVA_/S267K Heavy Chain

SEQ ID NO: 36578 - protein, 118 aa, Artificial Sequence; identical to SEQ ID NO: 36448
  Description of Artificial Sequence: Synthetic polypeptide
  VH of XENP021196

SEQ ID NO: 36579 - protein, 5 aa, Artificial Sequence
  Description of Artificial Sequence: Synthetic peptide
  XENP021196 vhCDR1
SYAVN

SEQ ID NO: 36580 - protein, 16 aa, Artificial Sequence
  Description of Artificial Sequence: Synthetic peptide
  XENP021196 vhCDR2
VIWSGGSTDYNAKFQG

SEQ ID NO: 36581 - protein, 10 aa, Artificial Sequence
  Description of Artificial Sequence: Synthetic peptide
  XENP021196 vhCDR3
LYYRYDGFDY

SEQ ID NO: 36582 - protein, 214 aa, Artificial Sequence
  Description of Artificial Sequence: Synthetic polypeptide
  XENP021196 7B11_H1_L1.1_IgG1_PVA_/S267K Light Chain
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36583 - protein, 107 aa, Artificial Sequence
  Description of Artificial Sequence: Synthetic polypeptide
  VL of XENP021196
DIVMTQSPSSLSASVGDRVTITCRASQNVGTHVAWYQQKPGKSPKALVYSASYRYSGVPDRFTGSGSGTDFTLTISSLQPEDFATYFCQQYNSYPLTFGGGTKVEIK

SEQ ID NO: 36584 - protein, 11 aa, Artificial Sequence
  Description of Artificial Sequence: Synthetic peptide
  XENP021196 vlCDR1
RASQNVGTHVA

SEQ ID NO: 36585 - protein, 7 aa, Artificial Sequence
  Description of Artificial Sequence: Synthetic peptide
  XENP021196 vlCDR2
SASYRYS

SEQ ID NO: 36586 - protein, 9 aa, Artificial Sequence
  Description of Artificial Sequence: Synthetic peptide
  XENP021196 vlCDR3
QQYNSYPLT

SEQ ID NO: 36587 - protein, 447 aa, Artificial Sequence; identical to SEQ ID NO: 36447
  Description of Artificial Sequence: Synthetic polypeptide
  XENP021201 7B11_H1_L2.1_IgG1_PVA_/S267K Heavy Chain

SEQ ID NO: 36588 - protein, 118 aa, Artificial Sequence; identical to SEQ ID NO: 36448
  Description of Artificial Sequence: Synthetic polypeptide
  VH of XENP021201

SEQ ID NO: 36589 - protein, 5 aa, Artificial Sequence
  Description of Artificial Sequence: Synthetic peptide
  XENP021201 vhCDR1
SYAVN

SEQ ID NO: 36590 - protein, 16 aa, Artificial Sequence
  Description of Artificial Sequence: Synthetic peptide
  XENP021201 vhCDR2
VIWSGGSTDYNAKFQG

SEQ ID NO: 36591 - protein, 10 aa, Artificial Sequence
  Description of Artificial Sequence: Synthetic peptide
  XENP021201 vhCDR3
LYYRYDGFDY

SEQ ID NO: 36592 - protein, 214 aa, Artificial Sequence
  Description of Artificial Sequence: Synthetic polypeptide
  XENP021201 7B11_H1_L2.1_IgG1_PVA_/S267K Light Chain
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36593 - protein, 107 aa, Artificial Sequence
  Description of Artificial Sequence: Synthetic polypeptide
  VL of XENP021201
DIVMTQSPDSLAVSLGERATINCKASQNVGTHVAWYQQKPGQSPKALVYSASYRYSGVPDRFTGSGSGTDFTLTISSLQAEDVAVYFCQQYNSYPLTFGGGTKVEIK

SEQ ID NO: 36594 - protein, 11 aa, Artificial Sequence
  Description of Artificial Sequence: Synthetic peptide
  XENP021201 vlCDR1
KASQNVGTHVA

SEQ ID NO: 36595 - protein, 7 aa, Artificial Sequence
  Description of Artificial Sequence: Synthetic peptide
  XENP021201 vlCDR2
SASYRYS

SEQ ID NO: 36596 - protein, 9 aa, Artificial Sequence
  Description of Artificial Sequence: Synthetic peptide
  XENP021201 vlCDR3
QQYNSYPLT

SEQ ID NO: 36597 - protein, 447 aa, Artificial Sequence
  Description of Artificial Sequence: Synthetic polypeptide
  XENP021202 7B11_H2.1_L1.1_IgG1_PVA_/S267K Heavy Chain
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36598 - protein, 118 aa, Artificial Sequence
  Description of Artificial Sequence: Synthetic polypeptide
  VH of XENP021202
EVQLVESGGGLVQPGGSLRLSCAVSGFSLTSYAVNWVRQAPGKGLEWVSVIWSGGSTDYNPSVKGRFTISKDNSKSTVYLQMNSLRAEDTAVYYCVSLYYRYDGFDYWGQGTLVTVSS

SEQ ID NO: 36599 - protein, 5 aa, Artificial Sequence
  Description of Artificial Sequence: Synthetic peptide
  XENP021202 vhCDR1
SYAVN

SEQ ID NO: 36600 - protein, 16 aa, Artificial Sequence
  Description of Artificial Sequence: Synthetic peptide
  XENP021202 vhCDR2
VIWSGGSTDYNPSVKG

SEQ ID NO: 36601 - protein, 10 aa, Artificial Sequence
  Description of Artificial Sequence: Synthetic peptide
  XENP021202 vhCDR3
LYYRYDGFDY

SEQ ID NO: 36602 - protein, 214 aa, Artificial Sequence; identical to SEQ ID NO: 36582
  Description of Artificial Sequence: Synthetic polypeptide
  XENP021202 7B11_H2.1_L1.1_IgG1_PVA_/S267K Light Chain

SEQ ID NO: 36603 - protein, 107 aa, Artificial Sequence; identical to SEQ ID NO: 36583
  Description of Artificial Sequence: Synthetic polypeptide
  VL of XENP021202

SEQ ID NO: 36604 - protein, 11 aa, Artificial Sequence
  Description of Artificial Sequence: Synthetic peptide
  XENP021202 vlCDR1
RASQNVGTHVA

SEQ ID NO: 36605 - protein, 7 aa, Artificial Sequence
  Description of Artificial Sequence: Synthetic peptide
  XENP021202 vlCDR2
SASYRYS

SEQ ID NO: 36606 - protein, 9 aa, Artificial Sequence
  Description of Artificial Sequence: Synthetic peptide
  XENP021202 vlCDR3
QQYNSYPLT

SEQ ID NO: 36607 - protein, 447 aa, Artificial Sequence; identical to SEQ ID NO: 36597
  Description of Artificial Sequence: Synthetic polypeptide
  XENP021203 7B11_H2.1_L2.1_IgG1_PVA_/S267K Heavy Chain

SEQ ID NO: 36608 - protein, 118 aa, Artificial Sequence; identical to SEQ ID NO: 36598
  Description of Artificial Sequence: Synthetic polypeptide
  VH of XENP021203

SEQ ID NO: 36609 - protein, 5 aa, Artificial Sequence
  Description of Artificial Sequence: Synthetic peptide
  XENP021203 vhCDR1
SYAVN

SEQ ID NO: 36610 - protein, 16 aa, Artificial Sequence
  Description of Artificial Sequence: Synthetic peptide
  XENP021203 vhCDR2
VIWSGGSTDYNPSVKG

SEQ ID NO: 36611 - protein, 10 aa, Artificial Sequence
  Description of Artificial Sequence: Synthetic peptide
  XENP021203 vhCDR3
LYYRYDGFDY

SEQ ID NO: 36612 - protein, 214 aa, Artificial Sequence; identical to SEQ ID NO: 36592
  Description of Artificial Sequence: Synthetic polypeptide
  XENP021203 7B11_H2.1_L2.1_IgG1_PVA_/S267K Light Chain

SEQ ID NO: 36613 - protein, 107 aa, Artificial Sequence; identical to SEQ ID NO: 36593
  Description of Artificial Sequence: Synthetic polypeptide
  VL of XENP021203

SEQ ID NO: 36614 - protein, 11 aa, Artificial Sequence
  Description of Artificial Sequence: Synthetic peptide
  XENP021203 vlCDR1
KASQNVGTHVA

SEQ ID NO: 36615 - protein, 7 aa, Artificial Sequence
  Description of Artificial Sequence: Synthetic peptide
  XENP021203 vlCDR2
SASYRYS

SEQ ID NO: 36616 - protein, 9 aa, Artificial Sequence
  Description of Artificial Sequence: Synthetic peptide
  XENP021203 vlCDR3
QQYNSYPLT

SEQ ID NO: 36617 - protein, 446 aa, Artificial Sequence
  Description of Artificial Sequence: Synthetic polypeptide
  XENP021204 7C2_H1.1_L1.1_IgG1_PVA_/S267K Heavy Chain
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36618 - protein, 117 aa, Artificial Sequence
  Description of Artificial Sequence: Synthetic polypeptide
  VH of XENP021204
EVQVLESGGGLVQPGGSLRLSCAASGFTFSRYAMSWVRQAPGKRLEWVSSISSGGSTYYPDSVKGRFTISRDNSKNTLYLQMNSLRAEDTAVYYCARGDYEGYFDYWGQGTLVTVSS

SEQ ID NO: 36619 - protein, 5 aa, Artificial Sequence
  Description of Artificial Sequence: Synthetic peptide
  XENP021204 vhCDR1
RYAMS

SEQ ID NO: 36620 - protein, 16 aa, Artificial Sequence
  Description of Artificial Sequence: Synthetic peptide
  XENP021204 vhCDR2
SISSGGSTYYPDSVKG

SEQ ID NO: 36621 - protein, 9 aa, Artificial Sequence
  Description of Artificial Sequence: Synthetic peptide
  XENP021204 vhCDR3
GDYEGYFDY

SEQ ID NO: 36622 - protein, 220 aa, Artificial Sequence
  Description of Artificial Sequence: Synthetic polypeptide
  XENP021204 7C2_H1.1_L1.1_IgG1_PVA_/S267K Light Chain
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36623 - protein, 113 aa, Artificial Sequence
  Description of Artificial Sequence: Synthetic polypeptide
  VL of XENP021204
DIVMTQSPDSLAVSLGERATINCKSSQSLLNSINQKNYLAWYQQKPGQSPKLLVYFASTRESGVPDRFIGSGSGTDFTLTISSLQAEDVAVYFCQQHYSTPLTFGAGTKLEIK

SEQ ID NO: 36624 - protein, 17 aa, Artificial Sequence
  Description of Artificial Sequence: Synthetic peptide
  XENP021204 vlCDR1
KSSQSLLNSINQKNYLA

SEQ ID NO: 36625 - protein, 7 aa, Artificial Sequence
  Description of Artificial Sequence: Synthetic peptide
  XENP021204 vlCDR2
FASTRES

SEQ ID NO: 36626 - protein, 9 aa, Artificial Sequence
  Description of Artificial Sequence: Synthetic peptide
  XENP021204 vlCDR3
QQHYSTPLT

SEQ ID NO: 36627 - protein, 442 aa, Artificial Sequence
  Description of Artificial Sequence: Synthetic polypeptide
  XENP021492 1D12_H0L0_IgG1_PVA_/S267K Heavy Chain
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36628 - protein, 113 aa, Artificial Sequence
  Description of Artificial Sequence: Synthetic polypeptide
  VH of XENP021492
EVQLVESGGGLVKPGGSLKFSCAASGFAFSSFDMSWVRQTPEKRLEWVAYISSDGASTFYPDTMKGRFTISRDNAKNTLYLQMSSLKSEDTAMYYCTRLGAYWGQGTLVTVSA

SEQ ID NO: 36629 - protein, 5 aa, Artificial Sequence
  Description of Artificial Sequence: Synthetic peptide
  XENP021492 vhCDR1
SFDMS

SEQ ID NO: 36630 - protein, 17 aa, Artificial Sequence
  Description of Artificial Sequence: Synthetic peptide
  XENP021492 vhCDR2
YISSDGASTFYPDTMKG

SEQ ID NO: 36631 - protein, 4 aa, Artificial Sequence
  Description of Artificial Sequence: Synthetic peptide
  XENP021492 vhCDR3
LGAY

SEQ ID NO: 36632 - protein, 218 aa, Artificial Sequence
  Description of Artificial Sequence: Synthetic polypeptide
  XENP021492 1D12_H0L0_IgG1_PVA_/S267K Light Chain
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36633 - protein, 111 aa, Artificial Sequence
  Description of Artificial Sequence: Synthetic polypeptide
  VL of XENP021492
DIVLTQSPASLAVSLGQRATISCRASESVEYYGTSLMQWYQQKPGQPPKLLIYAASNVESGVPARFSGSGSGTDFSLNIHPVEEDDIAMYFCQQSRKVPWTFGGGTKLEIK

SEQ ID NO: 36634 - protein, 15 aa, Artificial Sequence
  Description of Artificial Sequence: Synthetic peptide
  XENP021492 vlCDR1
RASESVEYYGTSLMQ

SEQ ID NO: 36635 - protein, 7 aa, Artificial Sequence
  Description of Artificial Sequence: Synthetic peptide
  XENP021492 vlCDR2
AASNVES

SEQ ID NO: 36636 - protein, 9 aa, Artificial Sequence
  Description of Artificial Sequence: Synthetic peptide
  XENP021492 vlCDR3
QQSRKVPWT

SEQ ID NO: 36637 - protein, 446 aa, Artificial Sequence
  Description of Artificial Sequence: Synthetic polypeptide
  XENP021493 6C8_H0L0_IgG1_PVA_/S267K Heavy Chain
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36638 - protein, 117 aa, Artificial Sequence
  Description of Artificial Sequence: Synthetic polypeptide
  VH of XENP021493
QVQLKESGPGLVAPSQSLSITCTVSGFSLNGYGVNWVRQPPGKGLEWLGMIWGDGSTDYNSALKSRLSISKDNSKSQVFLKMNSLQTDDTARYYCARSYYTSDEDYWGQGTLVTVSA

SEQ ID NO: 36639 - protein, 5 aa, Artificial Sequence
  Description of Artificial Sequence: Synthetic peptide
  XENP021493 vhCDR1
GYGVN

SEQ ID NO: 36640 - protein, 16 aa, Artificial Sequence
  Description of Artificial Sequence: Synthetic peptide
  XENP021493 vhCDR2
MIWGDGSTDYNSALKS

SEQ ID NO: 36641 - protein, 9 aa, Artificial Sequence
  Description of Artificial Sequence: Synthetic peptide
  XENP021493 vhCDR3
SYYTSDEDY

SEQ ID NO: 36642 - protein, 214 aa, Artificial Sequence
  Description of Artificial Sequence: Synthetic polypeptide
  XENP021493 6C8_H0L0_IgG1_PVA_/S267K Light Chain
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36643 - protein, 107 aa, Artificial Sequence
  Description of Artificial Sequence: Synthetic polypeptide
  VL of XENP021493
DIVMTQSQKFMSTSVGDRVSVTCKASQNVGSNVAWCQQKPGQSPKALIYSASFRYSGVPDRFTGSGSGTDFTLTISNVQSEDLAEYFCQQYNSYPYTFGGGTKLEIK

SEQ ID NO: 36644 - protein, 11 aa, Artificial Sequence
  Description of Artificial Sequence: Synthetic peptide
  XENP021493 vlCDR1
KASQNVGSNVA

SEQ ID NO: 36645 - protein, 7 aa, Artificial Sequence
  Description of Artificial Sequence: Synthetic peptide
  XENP021493 vlCDR2
SASFRYS

SEQ ID NO: 36646 - protein, 9 aa, Artificial Sequence
  Description of Artificial Sequence: Synthetic peptide
  XENP021493 vlCDR3
QQYNSYPYT

SEQ ID NO: 36647 - protein, 446 aa, Artificial Sequence
  Description of Artificial Sequence: Synthetic polypeptide
  XENP021494 6D9_H0_1D12_L0_IgG1_PVA_/S267K Heavy Chain
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36648 - protein, 117 aa, Artificial Sequence
  Description of Artificial Sequence: Synthetic polypeptide
  VH of XENP021494
QVQLKQSGPGLVQPSQSLSITCTVSGFSLTSYGVHWVRQSPGKGLEWLGVIWSGGSTEYNAAFISRLSISKDNSKSQVFFKMNSLQADDTAIYYCARGGLLSPFDYWGQGTTLTVSS

SEQ ID NO: 36649 - protein, 5 aa, Artificial Sequence
  Description of Artificial Sequence: Synthetic peptide
  XENP021494 vhCDR1
SYGVH

SEQ ID NO: 36650 - protein, 16 aa, Artificial Sequence
  Description of Artificial Sequence: Synthetic peptide
  XENP021494 vhCDR2
VIWSGGSTEYNAAFIS

SEQ ID NO: 36651 - protein, 9 aa, Artificial Sequence
  Description of Artificial Sequence: Synthetic peptide
  XENP021494 vhCDR3
GGLLSPFDY

SEQ ID NO: 36652 - protein, 218 aa, Artificial Sequence; identical to SEQ ID NO: 36632
  Description of Artificial Sequence: Synthetic polypeptide
  XENP021494 6D9_H0_1D12_L0_IgG1_PVA_/S267K Light Chain

SEQ ID NO: 36653 - protein, 111 aa, Artificial Sequence; identical to SEQ ID NO: 36633
  Description of Artificial Sequence: Synthetic polypeptide
  VL of XENP021494

SEQ ID NO: 36654 - protein, 15 aa, Artificial Sequence
  Description of Artificial Sequence: Synthetic peptide
  XENP021494 vlCDR1
RASESVEYYGTSLMQ

SEQ ID NO: 36655 - protein, 7 aa, Artificial Sequence
  Description of Artificial Sequence: Synthetic peptide
  XENP021494 vlCDR2
AASNVES

SEQ ID NO: 36656 - protein, 9 aa, Artificial Sequence
  Description of Artificial Sequence: Synthetic peptide
  XENP021494 vlCDR3
QQSRKVPWT

SEQ ID NO: 36657 - protein, 452 aa, Artificial Sequence
  Description of Artificial Sequence: Synthetic polypeptide
  XENP021495 7A9_H0L0_IgG1_PVA_/S267K Heavy Chain
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36658 - protein, 123 aa, Artificial Sequence
  Description of Artificial Sequence: Synthetic polypeptide
  VH of XENP021495
EVKLLESGGGLVQPGGSLKLSCAASGFDFSRYWMSWVRQAPGKGLEWIGEINPDSSTINYTPSLKDKFLISRDNAKNTLYLQMSKVRSEDTALYYCARPNGYYVGTIFPFAYWGQGTLVTVSA

SEQ ID NO: 36659 - protein, 5 aa, Artificial Sequence
  Description of Artificial Sequence: Synthetic peptide
  XENP021495 vhCDR1
RYWMS

SEQ ID NO: 36660 - protein, 17 aa, Artificial Sequence
  Description of Artificial Sequence: Synthetic peptide
  XENP021495 vhCDR2
EINPDSSTINYTPSLKD

SEQ ID NO: 36661 - protein, 14 aa, Artificial Sequence
  Description of Artificial Sequence: Synthetic peptide
  XENP021495 vhCDR3
PNGYYVGTIFPFAY

SEQ ID NO: 36662 - protein, 215 aa, Artificial Sequence
  Description of Artificial Sequence: Synthetic polypeptide
  XENP021495 7A9_H0L0_IgG1_PVA_/S267K Light Chain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 36663 - protein, 215 aa, Artificial Sequence; identical to SEQ ID NO: 36662
  Description of Artificial Sequence: Synthetic polypeptide
  VL of XENP021495

SEQ ID NO: 36664 - protein, 14 aa, Artificial Sequence
  Description of Artificial Sequence: Synthetic peptide
  XENP021495 vlCDR1
RSSTGAVTTSNYAN

SEQ ID NO: 36665 - protein, 7 aa, Artificial Sequence
  Description of Artificial Sequence: Synthetic peptide
  XENP021495 vlCDR2
GTNNRAP

SEQ ID NO: 36666 - protein, 9 aa, Artificial Sequence
  Description of Artificial Sequence: Synthetic peptide
  XENP021495 vlCDR3
ALWYSNHWV

SEQ ID NO: 36667 - protein, 447 aa, Artificial Sequence; identical to SEQ ID NO: 20835
  Description of Artificial Sequence: Synthetic polypeptide
  XENP021496 7B11_H0L0_IgG1_PVA_/S267K Heavy Chain

SEQ ID NO: 36668 - protein, 118 aa, Artificial Sequence; identical to SEQ ID NO: 20836
  Description of Artificial Sequence: Synthetic polypeptide
  VH of XENP021496

SEQ ID NO: 36669 - protein, 5 aa, Artificial Sequence
  Description of Artificial Sequence: Synthetic peptide
  XENP021496 vhCDR1
SYAVN

SEQ ID NO: 36670 - protein, 16 aa, Artificial Sequence
  Description of Artificial Sequence: Synthetic peptide
  XENP021496 vhCDR2
VIWSGGSTDYNAAFIS

SEQ ID NO: 36671 - protein, 10 aa, Artificial Sequence
  Description of Artificial Sequence: Synthetic peptide
  XENP021496 vhCDR3
LYYRYDGFDY

SEQ ID NO: 36672 - protein, 214 aa, Artificial Sequence
  Description of Artificial Sequence: Synthetic polypeptide
  XENP021496 7B11_H0L0_IgG1_PVA_/S267K Light Chain
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36673 - protein, 107 aa, Artificial Sequence
  Description of Artificial Sequence: Synthetic polypeptide
  VL of XENP021496
DIVMTQSQKFMSTSVGDRVSVTCKASQNVGTHVAWYQQKPGQSPKALVYSASYRYSGVPDRFTGSGSGTDFTLTISNVQSEDLAEYFCQQYNSYPLTFGGGTKLEIK

SEQ ID NO: 36674 - protein, 11 aa, Artificial Sequence
  Description of Artificial Sequence: Synthetic peptide
  XENP021496 vlCDR1
KASQNVGTHVA

SEQ ID NO: 36675 - protein, 7 aa, Artificial Sequence
  Description of Artificial Sequence: Synthetic peptide
  XENP021496 vlCDR2
SASYRYS

SEQ ID NO: 36676 - protein, 9 aa, Artificial Sequence
  Description of Artificial Sequence: Synthetic peptide
  XENP021496 vlCDR3
QQYNSYPLT

SEQ ID NO: 36677 - protein, 447 aa, Artificial Sequence; identical to SEQ ID NO: 20845
  Description of Artificial Sequence: Synthetic polypeptide
  XENP021501 7B11var_H0L0_IgG1_PVA_/S267K Heavy Chain

SEQ ID NO: 36678 - protein, 118 aa, Artificial Sequence; identical to SEQ ID NO: 20846
  Description of Artificial Sequence: Synthetic polypeptide
  VH of XENP021501

SEQ ID NO: 36679 - protein, 5 aa, Artificial Sequence
  Description of Artificial Sequence: Synthetic peptide
  XENP021501 vhCDR1
SYAVN

SEQ ID NO: 36680 - protein, 16 aa, Artificial Sequence
  Description of Artificial Sequence: Synthetic peptide
  XENP021501 vhCDR2
VIWSGGSTDYNAAFIS

SEQ ID NO: 36681 - protein, 10 aa, Artificial Sequence
  Description of Artificial Sequence: Synthetic peptide
  XENP021501 vhCDR3
LYYRYDGFDY

SEQ ID NO: 36682 - protein, 214 aa, Artificial Sequence; identical to SEQ ID NO: 36672
  Description of Artificial Sequence: Synthetic polypeptide
  XENP021501 7B11var_H0L0_IgG1_PVA_/S267K Light Chain

SEQ ID NO: 36683 - protein, 107 aa, Artificial Sequence; identical to SEQ ID NO: 36673
  Description of Artificial Sequence: Synthetic polypeptide
  VL of XENP021501

SEQ ID NO: 36684 - protein, 11 aa, Artificial Sequence
  Description of Artificial Sequence: Synthetic peptide
  XENP021501 vlCDR1
KASQNVGTHVA

SEQ ID NO: 36685 - protein, 7 aa, Artificial Sequence
  Description of Artificial Sequence: Synthetic peptide
  XENP021501 vlCDR2
SASYRYS

SEQ ID NO: 36686 - protein, 9 aa, Artificial Sequence
  Description of Artificial Sequence: Synthetic peptide
  XENP021501 vlCDR3
QQYNSYPLT

SEQ ID NO: 36687 - protein, 446 aa, Artificial Sequence
  Description of Artificial Sequence: Synthetic polypeptide
  XENP021502 7C2_H0L0_IgG1_PVA_/S267K Heavy Chain
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36688 - protein, 117 aa, Artificial Sequence
  Description of Artificial Sequence: Synthetic polypeptide
  VH of XENP021502
EVKVVESGGGLVKPGGSLKLSCAASGFTFSRYAMSWVRQTPEKRLEWVASISSGGSTYYPDSVQGRFTISRDNARNILYLQMSSLRSEDTAMYYCARGDYEGYFDYWGQGTSLTVSS

SEQ ID NO: 36689 - protein, 5 aa, Artificial Sequence
  Description of Artificial Sequence: Synthetic peptide
  XENP021502 vhCDR1
RYAMS

SEQ ID NO: 36690 - protein, 16 aa, Artificial Sequence
  Description of Artificial Sequence: Synthetic peptide
  XENP021502 vhCDR2
SISSGGSTYYPDSVQG

SEQ ID NO: 36691 - protein, 9 aa, Artificial Sequence
  Description of Artificial Sequence: Synthetic peptide
  XENP021502 vhCDR3
GDYEGYFDY

SEQ ID NO: 36692 - protein, 220 aa, Artificial Sequence
  Description of Artificial Sequence: Synthetic polypeptide
  XENP021502 7C2_H0L0_IgG1_PVA_/S267K Light Chain
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36693 - protein, 113 aa, Artificial Sequence
  Description of Artificial Sequence: Synthetic polypeptide
  VL of XENP021502
DIVMTQSPSSLAMSVGQKVTMSCKSSQSLLNSINQKNYLAWYQQKPGQSPKLLVYFASTRESGVPDRFIGSGSGTDFTLTISSVQAEDLADYFCQQHYSTPLTFGAGTKLELK

SEQ ID NO: 36694 - protein, 17 aa, Artificial Sequence
  Description of Artificial Sequence: Synthetic peptide
  XENP021502 vlCDR1
KSSQSLLNSINQKNYLA

SEQ ID NO: 36695 - protein, 7 aa, Artificial Sequence
  Description of Artificial Sequence: Synthetic peptide
  XENP021502 vlCDR2
FASTRES

SEQ ID NO: 36696 - protein, 9 aa, Artificial Sequence
  Description of Artificial Sequence: Synthetic peptide
  XENP021502 vlCDR3
QQHYSTPLT

SEQ ID NO: 36697 - protein, 442 aa, Artificial Sequence; identical to SEQ ID NO: 36627
  Description of Artificial Sequence: Synthetic polypeptide
  XENP021503 1D10_H0L0_IgG1_PVA_/S267K Heavy Chain

SEQ ID NO: 36698 - protein, 113 aa, Artificial Sequence; identical to SEQ ID NO: 36628
  Description of Artificial Sequence: Synthetic polypeptide
  VH of XENP021503

SEQ ID NO: 36699 - protein, 5 aa, Artificial Sequence
  Description of Artificial Sequence: Synthetic peptide
  XENP021503 vhCDR1
SFDMS

SEQ ID NO: 36700 - protein, 17 aa, Artificial Sequence
  Description of Artificial Sequence: Synthetic peptide
  XENP021503 vhCDR2
YISSDGASTFYPDTMKG

SEQ ID NO: 36701 - protein, 4 aa, Artificial Sequence
  Description of Artificial Sequence: Synthetic peptide
  XENP021503 vhCDR3
LGAY

SEQ ID NO: 36702 - protein, 219 aa, Artificial Sequence
  Description of Artificial Sequence: Synthetic polypeptide
  XENP021503 1D10_H0L0_IgG1_PVA_/S267K Light Chain
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36703 - protein, 112 aa, Artificial Sequence
  Description of Artificial Sequence: Synthetic polypeptide
  VL of XENP021503
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 36704 - protein, 16 aa, Artificial Sequence
  Description of Artificial Sequence: Synthetic peptide
  XENP021503 vlCDR1
KSSQSLLDSDGKTYLN

SEQ ID NO: 36705 - protein, 7 aa, Artificial Sequence
  Description of Artificial Sequence: Synthetic peptide
  XENP021503 vlCDR2
LVSKLDS

SEQ ID NO: 36706 - protein, 9 aa, Artificial Sequence
  Description of Artificial Sequence: Synthetic peptide
  XENP021503 vlCDR3
WQGTHFPYT

SEQ ID NO: 36707 - protein, 120 aa, Artificial Sequence
  Description of Artificial Sequence: Synthetic polypeptide
  3C2[BTLA] variable heavy Chain
QVQLQESGPGLVKPSETLSLTCTISGGSISNYYWNWIRQPPGKGLEWIGYIYYSTSTKYNPSLKSRVTMSVETSKNQFSLKLSSVTAADTAVYYCARVKVYSTGWFFDYWGQGTLVTVSS

SEQ ID NO: 36708 - protein, 5 aa, Artificial Sequence
  Description of Artificial Sequence: Synthetic peptide
  3C2[BTLA] vhCDR1
NYYWN

SEQ ID NO: 36709 - protein, 16 aa, Artificial Sequence
  Description of Artificial Sequence: Synthetic peptide
  3C2[BTLA] vhCDR2
YIYYSTSTKYNPSLKS

SEQ ID NO: 36710 - protein, 12 aa, Artificial Sequence
  Description of Artificial Sequence: Synthetic peptide
  3C2[BTLA] vhCDR3
VKVYSTGWFFDY

SEQ ID NO: 36711 - protein, 107 aa, Artificial Sequence [sequence omitted]

SEQ ID NO: 36712 - protein, 11 aa, Artificial Sequence
  Description of Artificial Sequence: Synthetic peptide
  3C2[BTLA] vlCDR1
RASQGISSALA

SEQ ID NO: 36713 - protein, 7 aa, Artificial Sequence
  Description of Artificial Sequence: Synthetic peptide
  3C2[BTLA] vlCDR2
DASSLES

SEQ ID NO: 36714 - protein, 9 aa, Artificial Sequence
  Description of Artificial Sequence: Synthetic peptide
  3C2[BTLA] vlCDR3
QQFNSYPLT

SEQ ID NO: 36715 - protein, 127 aa, Artificial Sequence
  Description of Artificial Sequence: Synthetic polypeptide
  11E2[BTLA] variable heavy Chain
EVQLVESGGGVIRPGGSLRLSCAASGFTFDDYGMSWVRQAPGKGLEWVSGINWNGGSTGYAASVKGRFTISRDNAKNSLYLQMNSLRAEDSALYYCARDYYYGPGSPNYFYYAMDVWGQGTTVTVSS

SEQ ID NO: 36716 - protein, 5 aa, Artificial Sequence
  Description of Artificial Sequence: Synthetic peptide
  11E2[BTLA] vhCDR1
DYGMS

SEQ ID NO: 36717 - protein, 17 aa, Artificial Sequence
  Description of Artificial Sequence: Synthetic peptide
  11E2[BTLA] vhCDR2
GINWNGGSTGYAASVKG

SEQ ID NO: 36718 - protein, 18 aa, Artificial Sequence
  Description of Artificial Sequence: Synthetic peptide
  11E2[BTLA] vhCDR3
DYYYGPGSPNYFYYAMDV

SEQ ID NO: 36719 - protein, 107 aa, Artificial Sequence
  Description of Artificial Sequence: Synthetic polypeptide
  11E2[BTLA] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 36720 - protein, 11 aa, Artificial Sequence
  Description of Artificial Sequence: Synthetic peptide
  11E2[BTLA] vlCDR1
RASQGISSWLA

SEQ ID NO: 36721 - protein, 7 aa, Artificial Sequence
  Description of Artificial Sequence: Synthetic peptide
  11E2[BTLA] vlCDR2
AASSLQS

SEQ ID NO: 36722 - protein, 9 aa, Artificial Sequence
  Description of Artificial Sequence: Synthetic peptide
  11E2[BTLA] vlCDR3
QQYNSYPRT

SEQ ID NO: 36723 - protein, 119 aa, Artificial Sequence; identical to SEQ ID NO: 20886
  Description of Artificial Sequence: Synthetic polypeptide
  4C7[BTLA] variable heavy Chain

SEQ ID NO: 36724 - protein, 5 aa, Artificial Sequence
  Description of Artificial Sequence: Synthetic peptide
  4C7[BTLA] vhCDR1
HYYWS

SEQ ID NO: 36725 - protein, 16 aa, Artificial Sequence
  Description of Artificial Sequence: Synthetic peptide
  4C7[BTLA] vhCDR2
YIYYSGSTKYNPSLKS

SEQ ID NO: 36726 - protein, 11 aa, Artificial Sequence
  Description of Artificial Sequence: Synthetic peptide
  4C7[BTLA] vhCDR3
EWPYYYYEMDV

SEQ ID NO: 36727 - protein, 108 aa, Artificial Sequence; identical to SEQ ID NO: 20891
  Description of Artificial Sequence: Synthetic polypeptide
  4C7[BTLA] variable light Chain

SEQ ID NO: 36728 - protein, 12 aa, Artificial Sequence
  Description of Artificial Sequence: Synthetic peptide
  4C7[BTLA] vlCDR1
RASQSVSSSYLA

SEQ ID NO: 36729 - protein, 7 aa, Artificial Sequence
  Description of Artificial Sequence: Synthetic peptide
  4C7[BTLA] vlCDR2
GASSRAT

SEQ ID NO: 36730 - protein, 9 aa, Artificial Sequence
  Description of Artificial Sequence: Synthetic peptide
  4C7[BTLA] vlCDR3
QQYGSSFRT

SEQ ID NO: 36731 - protein, 121 aa, Artificial Sequence; identical to SEQ ID NO: 20896
  Description of Artificial Sequence: Synthetic polypeptide
  8D5[BTLA] variable heavy Chain

SEQ ID NO: 36732 - protein, 5 aa, Artificial Sequence
  Description of Artificial Sequence: Synthetic peptide
  8D5[BTLA] vhCDR1
SYDMH

SEQ ID NO: 36733 - protein, 16 aa, Artificial Sequence
  Description of Artificial Sequence: Synthetic peptide
  8D5[BTLA] vhCDR2
VIGPAGDTYYPGSVKG

SEQ ID NO: 36734 - protein, 13 aa, Artificial Sequence
  Description of Artificial Sequence: Synthetic peptide
  8D5[BTLA] vhCDR3
EGMAAHNYYGMDV

SEQ ID NO: 36735 - protein, 108 aa, Artificial Sequence; identical to SEQ ID NO: 20901
  Description of Artificial Sequence: Synthetic polypeptide
  8D5[BTLA] variable light Chain

SEQ ID NO: 36736 - protein, 11 aa, Artificial Sequence
  Description of Artificial Sequence: Synthetic peptide
  8D5[BTLA] vlCDR1
RASQSVSSYLA

SEQ ID NO: 36737 - protein, 7 aa, Artificial Sequence
  Description of Artificial Sequence: Synthetic peptide
  8D5[BTLA] vlCDR2
DASNRAT

SEQ ID NO: 36738 - protein, 10 aa, Artificial Sequence
  Description of Artificial Sequence: Synthetic peptide
  8D5[BTLA] vlCDR3
QQRSNWPPIT

SEQ ID NO: 36739 - protein, 118 aa, Artificial Sequence; identical to SEQ ID NO: 22
  Description of Artificial Sequence: Synthetic polypeptide
  ipilimumab[CTLA-4] variable heavy Chain

SEQ ID NO: 36740 - protein, 5 aa, Artificial Sequence
  Description of Artificial Sequence: Synthetic peptide
  ipilimumab[CTLA-4] vhCDR1
SYTMH

SEQ ID NO: 36741 - protein, 17 aa, Artificial Sequence
  Description of Artificial Sequence: Synthetic peptide
  ipilimumab[CTLA-4] vhCDR2
FISYDGNNKYYADSVKG

SEQ ID NO: 36742 - protein, 9 aa, Artificial Sequence
  Description of Artificial Sequence: Synthetic peptide
  ipilimumab[CTLA-4] vhCDR3
TGWLGPFDY

SEQ ID NO: 36743 - protein, 108 aa, Artificial Sequence; identical to SEQ ID NO: 23
  Description of Artificial Sequence: Synthetic polypeptide
  ipilimumab[CTLA-4] variable light Chain

SEQ ID NO: 36744 - protein, 12 aa, Artificial Sequence
  Description of Artificial Sequence: Synthetic peptide
  ipilimumab[CTLA-4] vlCDR1
RASQSVGSSYLA

SEQ ID NO: 36745 - protein, 7 aa, Artificial Sequence
  Description of Artificial Sequence: Synthetic peptide
  ipilimumab[CTLA-4] vlCDR2
GAFSRAT

SEQ ID NO: 36746 - protein, 9 aa, Artificial Sequence
  Description of Artificial Sequence: Synthetic peptide
  ipilimumab[CTLA-4] vlCDR3
QQYGSSPWT

SEQ ID NO: 36747 - protein, 125 aa, Artificial Sequence; identical to SEQ ID NO: 22690
  Description of Artificial Sequence: Synthetic polypeptide
  tremelimumab[CTLA-4] variable heavy Chain

SEQ ID NO: 36748 - protein, 5 aa, Artificial Sequence
  Description of Artificial Sequence: Synthetic peptide
  tremelimumab[CTLA-4] vhCDR1
SYGMH

SEQ ID NO: 36749 - protein, 17 aa, Artificial Sequence
  Description of Artificial Sequence: Synthetic peptide
  tremelimumab[CTLA-4] vhCDR2
VIWYDGSNKYYADSVKG

SEQ ID NO: 36750 - protein, 16 aa, Artificial Sequence
  Description of Artificial Sequence: Synthetic peptide
  tremelimumab[CTLA-4] vhCDR3
DPRGATLYYYYYGMDV

SEQ ID NO: 36751 - protein, 107 aa, Artificial Sequence; identical to SEQ ID NO: 22691
  Description of Artificial Sequence: Synthetic polypeptide
  tremelimumab[CTLA-4] variable light Chain

SEQ ID NO: 36752 - protein, 11 aa, Artificial Sequence
  Description of Artificial Sequence: Synthetic peptide
  tremelimumab[CTLA-4] vlCDR1
RASQSINSYLD

SEQ ID NO: 36753 - protein, 7 aa, Artificial Sequence
  Description of Artificial Sequence: Synthetic peptide
  tremelimumab[CTLA-4] vlCDR2
AASSLQS

SEQ ID NO: 36754 - protein, 9 aa, Artificial Sequence
  Description of Artificial Sequence: Synthetic peptide
  tremelimumab[CTLA-4] vlCDR3
QQYYSTPFT

SEQ ID NO: 36755 - protein, 118 aa, Artificial Sequence
  Description of Artificial Sequence: Synthetic polypeptide
  AGEN1884[CTLA-4] variable heavy Chain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVGLMGPFDIWGQGTMVTVSS

SEQ ID NO: 36756 - protein, 5 aa, Artificial Sequence
  Description of Artificial Sequence: Synthetic peptide
  AGEN1884[CTLA-4] vhCDR1
SYSMN

SEQ ID NO: 36757 - protein, 17 aa, Artificial Sequence
  Description of Artificial Sequence: Synthetic peptide
  AGEN1884[CTLA-4] vhCDR2
SISSSSSYIYYADSVKG

SEQ ID NO: 36758 - protein, 9 aa, Artificial Sequence
  Description of Artificial Sequence: Synthetic peptide
  AGEN1884[CTLA-4] vhCDR3
VGLMGPFDI

SEQ ID NO: 36759 - protein, 107 aa, Artificial Sequence
  Description of Artificial Sequence: Synthetic polypeptide
  AGEN1884[CTLA-4] variable light Chain
EIVLTQSPGTLSLSPGERATLSCRASQSVSRYLGWYQQKPGQAPRLLIYGASTRATGIPDRFSGSGSGTDFTLTITRLEPEDFAVYYCQQYGSSPWTFGQGTKVEIK

SEQ ID NO: 36760 - protein, 11 aa, Artificial Sequence
  Description of Artificial Sequence: Synthetic peptide
  AGEN1884[CTLA-4] vlCDR1
RASQSVSRYLG

SEQ ID NO: 36761 - protein, 7 aa, Artificial Sequence
  Description of Artificial Sequence: Synthetic peptide
  AGEN1884[CTLA-4] vlCDR2
GASTRAT

SEQ ID NO: 36762 - protein, 9 aa, Artificial Sequence
  Description of Artificial Sequence: Synthetic peptide
  AGEN1884[CTLA-4] vlCDR3
QQYGSSPWT

SEQ ID NO: 36763 - protein, 116 aa, Artificial Sequence
  Description of Artificial Sequence: Synthetic polypeptide
  4.3F6B5[CTLA-4] variable heavy Chain
EVQLQPSGPVLVKPGASVKISCKASGYTFTDYKIHWVKQSHGKSLEWIGYIYPYSGSSDYNQKFKSKATLTVDNSSTTAYMELRSLTSEDSAVYYCARGGDAMDYWGQGTAVTVSS

SEQ ID NO: 36764 - protein, 5 aa, Artificial Sequence
  Description of Artificial Sequence: Synthetic peptide
  4.3F6B5[CTLA-4] vhCDR1
DYKIH

SEQ ID NO: 36765 - protein, 17 aa, Artificial Sequence
  Description of Artificial Sequence: Synthetic peptide
  4.3F6B5[CTLA-4] vhCDR2
YIYPYSGSSDYNQKFKS

SEQ ID NO: 36766 - protein, 7 aa, Artificial Sequence
  Description of Artificial Sequence: Synthetic peptide
  4.3F6B5[CTLA-4] vhCDR3
GGDAMDY

SEQ ID NO: 36767 - protein, 106 aa, Artificial Sequence
  Description of Artificial Sequence: Synthetic polypeptide
  4.3F6B5[CTLA-4] variable light Chain
DILMTQSPASLSASVGETVTITCGASENIYGALNWYQRKQGKSPQLLIYGATNLADGMSSRFSGSGLGRQYYLKISSLHPDDVATYFCQNILGTWTFGGGTKLEIK

SEQ ID NO: 36768 - protein, 11 aa, Artificial Sequence
  Description of Artificial Sequence: Synthetic peptide
  4.3F6B5[CTLA-4] vlCDR1
GASENIYGALN

SEQ ID NO: 36769 - protein, 7 aa, Artificial Sequence
  Description of Artificial Sequence: Synthetic peptide
  4.3F6B5[CTLA-4] vlCDR2
GATNLAD

SEQ ID NO: 36770 - protein, 8 aa, Artificial Sequence
  Description of Artificial Sequence: Synthetic peptide
  4.3F6B5[CTLA-4] vlCDR3
QNILGTWT

SEQ ID NO: 36771 - protein, 117 aa, Artificial Sequence
  Description of Artificial Sequence: Synthetic polypeptide
  4.8H10H5[CTLA-4] variable heavy Chain
DVKLVESGGGLVKLGGSLKLSCAASGFTFNIYYMSWVRQTPEKRLELVAAINPDGGNTYYPDTVKGRFTISRDNAKNTLYLQMSSLKSEDSALYYCARYGGPGFDSWGQGTTLTVSS

SEQ ID NO: 36772 - protein, 5 aa, Artificial Sequence
  Description of Artificial Sequence: Synthetic peptide
  4.8H10H5[CTLA-4] vhCDR1
IYYMS

SEQ ID NO: 36773 - protein, 17 aa, Artificial Sequence
  Description of Artificial Sequence: Synthetic peptide
  4.8H10H5[CTLA-4] vhCDR2
AINPDGGNTYYPDTVKG

SEQ ID NO: 36774 - protein, 8 aa, Artificial Sequence
  Description of Artificial Sequence: Synthetic peptide
  4.8H10H5[CTLA-4] vhCDR3
YGGPGFDS

SEQ ID NO: 36775 - protein, 108 aa, Artificial Sequence
  Description of Artificial Sequence: Synthetic polypeptide
  4.8H10H5[CTLA-4] variable light Chain
ENVLTQSPAIMSASPGERVTMTCSASSSVSYMHWYQQKSNTSPKLWIYDTSKLASGVPGRFSGSGSRNSYSLTISSMEAEDVATYYCFPGSGFPFMYTFGGGTKLEIK

SEQ ID NO: 36776 - protein, 10 aa, Artificial Sequence
  Description of Artificial Sequence: Synthetic peptide
  4.8H10H5[CTLA-4] vlCDR1
SASSSVSYMH

SEQ ID NO: 36777 - protein, 7 aa, Artificial Sequence
  Description of Artificial Sequence: Synthetic peptide
  4.8H10H5[CTLA-4] vlCDR2
DTSKLAS

SEQ ID NO: 36778 - protein, 11 aa, Artificial Sequence
  Description of Artificial Sequence: Synthetic peptide
  4.8H10H5[CTLA-4] vlCDR3
FPGSGFPFMYT

SEQ ID NO: 36779 - protein, 116 aa, Artificial Sequence
  Description of Artificial Sequence: Synthetic polypeptide
  TGN2122.C[CTLA-4] variable heavy Chain
QVQLVQSGAEVKKPGASVKVSCKASGYTFTDYKIHWVRQAPGQGLEWIGYIYPYSGSSDYNQKFKSRATLTVDNSISTAYMELSRLRSDDTAVYYCARGGDAMDYWGQGTLVTVSS

SEQ ID NO: 36780 - protein, 5 aa, Artificial Sequence
  Description of Artificial Sequence: Synthetic peptide
  TGN2122.C[CTLA-4] vhCDR1
DYKIH

SEQ ID NO: 36781 - protein, 17 aa, Artificial Sequence
  Description of Artificial Sequence: Synthetic peptide
  TGN2122.C[CTLA-4] vhCDR2
YIYPYSGSSDYNQKFKS

SEQ ID NO: 36782 - protein, 7 aa, Artificial Sequence
  Description of Artificial Sequence: Synthetic peptide
  TGN2122.C[CTLA-4] vhCDR3
GGDAMDY

SEQ ID NO: 36783 - protein, 106 aa, Artificial Sequence
  Description of Artificial Sequence: Synthetic polypeptide
  TGN2122.C[CTLA-4] variable light Chain
DIQMTQSPSSLSASVGDRVTITCGASENIYGALNWYQRKPGKAPKLLIYGATNLADGVPSRFSGSGSGRDYTLTISSLQPEDFATYFCQNILGTWTFGGGTKVEIK

SEQ ID NO: 36784 - protein, 11 aa, Artificial Sequence
  Description of Artificial Sequence: Synthetic peptide
  TGN2122.C[CTLA-4] vlCDR1
GASENIYGALN

SEQ ID NO: 36785 - protein, 7 aa, Artificial Sequence
  Description of Artificial Sequence: Synthetic peptide
  TGN2122.C[CTLA-4] vlCDR2
GATNLAD

SEQ ID NO: 36786 - protein, 8 aa, Artificial Sequence
  Description of Artificial Sequence: Synthetic peptide
  TGN2122.C[CTLA-4] vlCDR3
QNILGTWT

SEQ ID NO: 36787 - protein, 117 aa, Artificial Sequence
  Description of Artificial Sequence: Synthetic polypeptide
  TGN2122.H[CTLA-4] variable heavy Chain
EVQLVESGGGLVQPGGSLRLSCAASGFTFNIYYMSWVRQAPGKGLELVAAINPDGGNTYYPDTVKGRFTISRDNAKNSLYLQMNSLRAEDTAVYYCARYGGPGFDSWGQGTLVTVSS

SEQ ID NO: 36788 - protein, 5 aa, Artificial Sequence
  Description of Artificial Sequence: Synthetic peptide
  TGN2122.H[CTLA-4] vhCDR1
IYYMS

SEQ ID NO: 36789 - protein, 17 aa, Artificial Sequence
  Description of Artificial Sequence: Synthetic peptide
  TGN2122.H[CTLA-4] vhCDR2
AINPDGGNTYYPDTVKG

SEQ ID NO: 36790 - protein, 8 aa, Artificial Sequence
  Description of Artificial Sequence: Synthetic peptide
  TGN2122.H[CTLA-4] vhCDR3
YGGPGFDS

SEQ ID NO: 36791 - protein, 108 aa, Artificial Sequence
  Description of Artificial Sequence: Synthetic polypeptide
  TGN2122.H[CTLA-4] variable light Chain
ENVLTQSPATLSLSPGERATLSCSASSSVSYMHWYQQKPGQAPRLWIYDTSKLASGIPARFSGSGSRNDYTLTISSLEPEDFAVYYCFPGSGFPFMYTFGGGTKVEIK

SEQ ID NO: 36792 - protein, 10 aa, Artificial Sequence
  Description of Artificial Sequence: Synthetic peptide
  TGN2122.H[CTLA-4] vlCDR1
SASSSVSYMH

SEQ ID NO: 36793 - protein, 7 aa, Artificial Sequence
  Description of Artificial Sequence: Synthetic peptide
  TGN2122.H[CTLA-4] vlCDR2
DTSKLAS

SEQ ID NO: 36794 - protein, 11 aa, Artificial Sequence
  Description of Artificial Sequence: Synthetic peptide
  TGN2122.H[CTLA-4] vlCDR3
FPGSGFPFMYT

SEQ ID NO: 36795 - protein, 123 aa, Artificial Sequence
  Description of Artificial Sequence: Synthetic polypeptide
  F7[CTLA-4] variable heavy Chain
QVQLVQSGAEVKKPGASVKVSCKASGYAFDGHYMHWVRQAPGQRLEWMGWVDPHSGATNYAQNFQGGVTMTRDTSINTVYMELSSLKSDDTAVYYCARDFYDTSAKSGAFDIWGQGTMVTVSS

SEQ ID NO: 36796 - protein, 5 aa, Artificial Sequence
  Description of Artificial Sequence: Synthetic peptide
  F7[CTLA-4] vhCDR1
GHYMH

SEQ ID NO: 36797 - protein, 17 aa, Artificial Sequence
  Description of Artificial Sequence: Synthetic peptide
  F7[CTLA-4] vhCDR2
WVDPHSGATNYAQNFQG

SEQ ID NO: 36798 - protein, 14 aa, Artificial Sequence
  Description of Artificial Sequence: Synthetic peptide
  F7[CTLA-4] vhCDR3
DFYDTSAKSGAFDI

SEQ ID NO: 36799 - protein, 107 aa, Artificial Sequence
  Description of Artificial Sequence: Synthetic polypeptide
  F7[CTLA-4] variable light Chain
AIQLTQSPSSVSASVGDRVTITCRASQGISSWLAWYQQKPGKAPKLLIYAASSLQSGVPSRFSGSGSGTDFTLTISSLQPEDFATYYCQQVNSFPWAFGQGTKVEIK

SEQ ID NO: 36800 - protein, 11 aa, Artificial Sequence
  Description of Artificial Sequence: Synthetic peptide
  F7[CTLA-4] vlCDR1
RASQGISSWLA

SEQ ID NO: 36801 - protein, 7 aa, Artificial Sequence
  Description of Artificial Sequence: Synthetic peptide
  F7[CTLA-4] vlCDR2
AASSLQS

SEQ ID NO: 36802 - protein, 9 aa, Artificial Sequence
  Description of Artificial Sequence: Synthetic peptide
  F7[CTLA-4] vlCDR3
QQVNSFPWA

SEQ ID NO: 36803 - protein, 121 aa, Artificial Sequence
  Description of Artificial Sequence: Synthetic polypeptide
  E8[CTLA-4] variable heavy Chain
QVQLVQSGAEVKKPGASVKVSCEASGYTFTNYYIHWLRQAPGQGLEWMGIINPSGGSTTYAQKFQGRITMTRDTSTNTLYMELSSLRSEDTAIYYCARRDCRGPSCYFAYWGQGTTVTVSS

SEQ ID NO: 36804 - protein, 5 aa, Artificial Sequence
  Description of Artificial Sequence: Synthetic peptide
  E8[CTLA-4] vhCDR1
NYYIH

SEQ ID NO: 36805 - protein, 17 aa, Artificial Sequence
  Description of Artificial Sequence: Synthetic peptide
  E8[CTLA-4] vhCDR2
IINPSGGSTTYAQKFQG

SEQ ID NO: 36806 - protein, 12 aa, Artificial Sequence
  Description of Artificial Sequence: Synthetic peptide
  E8[CTLA-4] vhCDR3
RDCRGPSCYFAY

SEQ ID NO: 36807 - protein, 107 aa, Artificial Sequence
  Description of Artificial Sequence: Synthetic polypeptide
  E8[CTLA-4] variable light Chain
DIVMTQSPSSLSASVGDRVTITCRASQSISSYLNWYQQKPGKAPKLLIYAASSLQSGVPPRFSGSGSGTEFTLTISSLQPEDFATYYCQQANSFPPTFGQGTKVDIK

SEQ ID NO: 36808 - protein, 11 aa, Artificial Sequence
  Description of Artificial Sequence: Synthetic peptide
  E8[CTLA-4] vlCDR1
RASQSISSYLN

SEQ ID NO: 36809 - protein, 7 aa, Artificial Sequence
  Description of Artificial Sequence: Synthetic peptide
  E8[CTLA-4] vlCDR2
AASSLQS

SEQ ID NO: 36810 - protein, 9 aa, Artificial Sequence
  Description of Artificial Sequence: Synthetic peptide
  E8[CTLA-4] vlCDR3
QQANSFPPT

SEQ ID NO: 36811 - protein, 114 aa, Artificial Sequence
  Description of Artificial Sequence: Synthetic polypeptide
  CT1E1[CTLA-4] variable heavy Chain
EVQLVESGGGLVQPGRSLRLSCRGSNFNFDDLAISWVRQAPGKGLEWLGFVRSKAYGETTDYVASVKGRFTISRDDSKFIAWLQMDSLKTDDTAVYYCTTFNYWGQGTLVTVSS

SEQ ID NO: 36812 - protein, 5 aa, Artificial Sequence
  Description of Artificial Sequence: Synthetic peptide
  CT1E1[CTLA-4] vhCDR1
DLAIS

SEQ ID NO: 36813 - protein, 19 aa, Artificial Sequence
  Description of Artificial Sequence: Synthetic peptide
  CT1E1[CTLA-4] vhCDR2
FVRSKAYGETTDYVASVKG

SEQ ID NO: 36814 - protein, 3 aa, Artificial Sequence
  Description of Artificial Sequence: Synthetic peptide
  CT1E1[CTLA-4] vhCDR3
FNY

SEQ ID NO: 36815 - protein, 108 aa, Artificial Sequence
  Description of Artificial Sequence: Synthetic polypeptide
  CT1E1[CTLA-4] variable light Chain
QPVLTQPPSVSVAPGKTARISCGGNNIASEAVHWYQKKPGQAPVLVIYYDSDRPSGIPERFSGSNSGNTATLRISRVDAGDEADYYCQVWDRTTDQPVFGGGTKLTVL

SEQ ID NO: 36816 - protein, 11 aa, Artificial Sequence
  Description of Artificial Sequence: Synthetic peptide
  CT1E1[CTLA-4] vlCDR1
GGNNIASEAVH

SEQ ID NO: 36817 - protein, 7 aa, Artificial Sequence
  Description of Artificial Sequence: Synthetic peptide
  CT1E1[CTLA-4] vlCDR2
YDSDRPS

SEQ ID NO: 36818 - protein, 11 aa, Artificial Sequence
  Description of Artificial Sequence: Synthetic peptide
  CT1E1[CTLA-4] vlCDR3
QVWDRTTDQPV

SEQ ID NO: 36819 - protein, 120 aa, Artificial Sequence
  Description of Artificial Sequence: Synthetic polypeptide
  BMS-986016[LAG-3] variable heavy Chain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSS

SEQ ID NO: 36820 - protein, 5 aa, Artificial Sequence
  Description of Artificial Sequence: Synthetic peptide
  BMS-986016[LAG-3] vhCDR1
DYYWN

SEQ ID NO: 36821 - protein, 16 aa, Artificial Sequence
  Description of Artificial Sequence: Synthetic peptide
  BMS-986016[LAG-3] vhCDR2
EINHRGSTNSNPSLKS

SEQ ID NO: 36822 - protein, 12 aa, Artificial Sequence
  Description of Artificial Sequence: Synthetic peptide
  BMS-986016[LAG-3] vhCDR3
GYSDYEYNWFDP

SEQ ID NO: 36823 - protein, 107 aa, Artificial Sequence; identical to SEQ ID NO: 17141
  Description of Artificial Sequence: Synthetic polypeptide
  BMS-986016[LAG-3] variable light Chain

SEQ ID NO: 36824 - protein, 11 aa, Artificial Sequence
  Description of Artificial Sequence: Synthetic peptide
  BMS-986016[LAG-3] vlCDR1
RASQSISSYLA

SEQ ID NO: 36825 - protein, 7 aa, Artificial Sequence
  Description of Artificial Sequence: Synthetic peptide
  BMS-986016[LAG-3] vlCDR2
DASNRAT

SEQ ID NO: 36826 - protein, 9 aa, Artificial Sequence
  Description of Artificial Sequence: Synthetic peptide
  BMS-986016[LAG-3] vlCDR3
QQRSNWPLT

SEQ ID NO: 36827 - protein, 116 aa, Artificial Sequence
  Description of Artificial Sequence: Synthetic polypeptide
  IMP731[LAG-3] variable heavy Chain
QVQLKESGPGLVAPSQSLSITCTVSGFSLTAYGVNWVRQPPGKGLEWLGMIWDDGSTDYNSALKSRLSISKDNSKSQVFLKMNSLQTDDTARYYCAREGDVAFDYWGQGTTLTVSS

SEQ ID NO: 36828 - protein, 5 aa, Artificial Sequence
  Description of Artificial Sequence: Synthetic peptide
  IMP731[LAG-3] vhCDR1
AYGVN

SEQ ID NO: 36829 - protein, 16 aa, Artificial Sequence
  Description of Artificial Sequence: Synthetic peptide
  IMP731[LAG-3] vhCDR2
MIWDDGSTDYNSALKS

SEQ ID NO: 36830 - protein, 8 aa, Artificial Sequence
  Description of Artificial Sequence: Synthetic peptide
  IMP731[LAG-3] vhCDR3
EGDVAFDY

SEQ ID NO: 36831 - protein, 113 aa, Artificial Sequence
  Description of Artificial Sequence: Synthetic polypeptide
  IMP731[LAG-3] variable light Chain
DIVMTQSPSSLAVSVGQKVTMSCKSSQSLLNGSNQKNYLAWYQQKPGQSPKLLVYFASTRDSGVPDRFIGSGSGTDFTLTISSVQAEDLADYFCLQHFGTPPTFGGGTKLEIK

SEQ ID NO: 36832 - protein, 17 aa, Artificial Sequence
  Description of Artificial Sequence: Synthetic peptide
  IMP731[LAG-3] vlCDR1
KSSQSLLNGSNQKNYLA

SEQ ID NO: 36833 - protein, 7 aa, Artificial Sequence
  Description of Artificial Sequence: Synthetic peptide
  IMP731[LAG-3] vlCDR2
FASTRDS

SEQ ID NO: 36834 - protein, 9 aa, Artificial Sequence
  Description of Artificial Sequence: Synthetic peptide
  IMP731[LAG-3] vlCDR3
LQHFGTPPT

SEQ ID NO: 36835 - protein, 123 aa, Artificial Sequence
  Description of Artificial Sequence: Synthetic polypeptide
  13E2[LAG-3] variable heavy Chain
QVTLKESGPGILQPSQTLSLTCSFSGFSLSTSGMGLGWIRQPSGKGLEWLTHIWWDDIKRYNPDLRSRLTISKDTSSSQIFLKIASVDTADTATYYCARIVEGSYSSSYFDVWGAGTTVTVSS

SEQ ID NO: 36836 - protein, 7 aa, Artificial Sequence
  Description of Artificial Sequence: Synthetic peptide
  13E2[LAG-3] vhCDR1
TSGMGLG

SEQ ID NO: 36837 - protein, 16 aa, Artificial Sequence
  Description of Artificial Sequence: Synthetic peptide
  13E2[LAG-3] vhCDR2
HIWWDDIKRYNPDLRS

SEQ ID NO: 36838 - protein, 13 aa, Artificial Sequence
  Description of Artificial Sequence: Synthetic peptide
  13E2[LAG-3] vhCDR3
IVEGSYSSSYFDV

SEQ ID NO: 36839 - protein, 107 aa, Artificial Sequence
  Description of Artificial Sequence: Synthetic polypeptide
  13E2[LAG-3] variable light Chain
DIVMTQPHKFMSTSVEDRVTITCKASQDVIFDVAWYQQKPGQSPKLLIYSASSRVSGVPDRFTGSGSGTDFTFTISSVQAEDLAVYYCQQHYSTPYTFGGGTTLEIK

SEQ ID NO: 36840 - protein, 11 aa, Artificial Sequence
  Description of Artificial Sequence: Synthetic peptide
  13E2[LAG-3] vlCDR1
KASQDVIFDVA

SEQ ID NO: 36841 - protein, 7 aa, Artificial Sequence
  Description of Artificial Sequence: Synthetic peptide
  13E2[LAG-3] vlCDR2
SASSRVS

SEQ ID NO: 36842 - protein, 9 aa, Artificial Sequence
  Description of Artificial Sequence: Synthetic peptide
  13E2[LAG-3] vlCDR3
QQHYSTPYT

SEQ ID NO: 36843 - protein, 123 aa, Artificial Sequence
  Description of Artificial Sequence: Synthetic polypeptide
  34F4[LAG-3] variable heavy Chain
QVTLKESGPGILQPSQTLSLTCSFSGFSLNTSGMGVGWIRQPSGKGLEWLTHIWWDDVKRYNPALKSRLTISKDTSSSQVFLKIASVDTADTATYYCARIEGDTYYDYYFDYWGQGVTLTVSS

SEQ ID NO: 36844 - protein, 7 aa, Artificial Sequence
  Description of Artificial Sequence: Synthetic peptide
  34F4[LAG-3] vhCDR1
TSGMGVG

SEQ ID NO: 36845 - protein, 16 aa, Artificial Sequence
  Description of Artificial Sequence: Synthetic peptide
  34F4[LAG-3] vhCDR2
HIWWDDVKRYNPALKS

SEQ ID NO: 36846 - protein, 13 aa, Artificial Sequence
  Description of Artificial Sequence: Synthetic peptide
  34F4[LAG-3] vhCDR3
IEGDTYYDYYFDY

SEQ ID NO: 36847 - protein, 107 aa, Artificial Sequence
  Description of Artificial Sequence: Synthetic polypeptide
  34F4[LAG-3] variable light Chain
DIVMTQSHKLMSTSVGDGLSITCKASQDVSIAVVWYQQKPGQSPKLLIYSASFRYTGVPDRFTGSGSGTDFTFTISSVQAEDLAVYYCQQHYSIPWTFGGGTKLEIK

SEQ ID NO: 36848 - protein, 11 aa, Artificial Sequence
  Description of Artificial Sequence: Synthetic peptide
  34F4[LAG-3] vlCDR1
KASQDVSIAVV

SEQ ID NO: 36849 - protein, 7 aa, Artificial Sequence
  Description of Artificial Sequence: Synthetic peptide
  34F4[LAG-3] vlCDR2
SASFRYT

SEQ ID NO: 36850 - protein, 9 aa, Artificial Sequence
  Description of Artificial Sequence: Synthetic peptide
  34F4[LAG-3] vlCDR3
QQHYSIPWT

SEQ ID NO: 36851 - protein, 123 aa, Artificial Sequence
  Description of Artificial Sequence: Synthetic polypeptide
  IMP761[LAG-3] variable heavy Chain
QITLKESGPTLVKPTQTLTLTCTFSGFSLSTSGMGLGWIRQPPGKTLEWLTHIWWDDIKRYNPDLRSRLSITKDTSKNQVVLTMTNMDPLDTGTYYCARIVEGSYSSSYFDVWGQGTLVTVSS

SEQ ID NO: 36852 - protein, 7 aa, Artificial Sequence
  Description of Artificial Sequence: Synthetic peptide
  IMP761[LAG-3] vhCDR1
TSGMGLG

SEQ ID NO: 36853 - protein, 16 aa, Artificial Sequence
  Description of Artificial Sequence: Synthetic peptide
  IMP761[LAG-3] vhCDR2
HIWWDDIKRYNPDLRS

SEQ ID NO: 36854 - protein, 13 aa, Artificial Sequence
  Description of Artificial Sequence: Synthetic peptide
  IMP761[LAG-3] vhCDR3
IVEGSYSSSYFDV

SEQ ID NO: 36855 - protein, 107 aa, Artificial Sequence
  Description of Artificial Sequence: Synthetic polypeptide
  IMP761[LAG-3] variable light Chain
DIVMTQTPSSLSASVGDRVTITCKASQDVIFDVAWYQQRPGQAPKLLIYSASSRVSGVPSRFSGSGSGTDFTLTISSLQPEDFATYYCQQHYSTPYTFGQGTRLDIK

SEQ ID NO: 36856 - protein, 11 aa, Artificial Sequence
  Description of Artificial Sequence: Synthetic peptide
  IMP761[LAG-3] vlCDR1
KASQDVIFDVA

SEQ ID NO: 36857 - protein, 7 aa, Artificial Sequence
  Description of Artificial Sequence: Synthetic peptide
  IMP761[LAG-3] vlCDR2
SASSRVS

SEQ ID NO: 36858 - protein, 9 aa, Artificial Sequence
  Description of Artificial Sequence: Synthetic peptide
  IMP761[LAG-3] vlCDR3
QQHYSTPYT

SEQ ID NO: 36859 - protein, 116 aa, Artificial Sequence
  Description of Artificial Sequence: Synthetic polypeptide
  H5L7[LAG-3] variable heavy Chain
QVQLQESGPGLVKPSETLSLTCTVSGFSLTAYGVNWIRQPPGKGLEWIGMIWDDGSTDYDSALKSRVTISVDTSKNQFSLKLSSVTAADTAVYYCAREGDVAFDYWGQGTLVTVSS

SEQ ID NO: 36860 - protein, 5 aa, Artificial Sequence
  Description of Artificial Sequence: Synthetic peptide
  H5L7[LAG-3] vhCDR1
AYGVN

SEQ ID NO: 36861 - protein, 16 aa, Artificial Sequence
  Description of Artificial Sequence: Synthetic peptide
  H5L7[LAG-3] vhCDR2
MIWDDGSTDYDSALKS

SEQ ID NO: 36862 - protein, 8 aa, Artificial Sequence
  Description of Artificial Sequence: Synthetic peptide
  H5L7[LAG-3] vhCDR3
EGDVAFDY

SEQ ID NO: 36863 - protein, 113 aa, Artificial Sequence
  Description of Artificial Sequence: Synthetic polypeptide
  H5L7[LAG-3] variable light Chain
DIQMTQSPSSLSASVGDRVTITCKSSQSLLNPSNQKNYLAWYQQKPGKAPKLLVYFASTRDSGVPSRFSGSGSGTDFTLTISSLQPEDFATYYCLQHFGTPPTFGQGTKLEIK

SEQ ID NO: 36864 - protein, 17 aa, Artificial Sequence
  Description of Artificial Sequence: Synthetic peptide
  H5L7[LAG-3] vlCDR1
KSSQSLLNPSNQKNYLA

SEQ ID NO: 36865 - protein, 7 aa, Artificial Sequence
  Description of Artificial Sequence: Synthetic peptide
  H5L7[LAG-3] vlCDR2
FASTRDS

SEQ ID NO: 36866 - protein, 9 aa, Artificial Sequence
  Description of Artificial Sequence: Synthetic peptide
  H5L7[LAG-3] vlCDR3
LQHFGTPPT

SEQ ID NO: 36867 - protein, 119 aa, Artificial Sequence
  Description of Artificial Sequence: Synthetic polypeptide
  hu22D2[LAG-3] variable heavy Chain
QMQLVQSGPEVKKPGTSVKVSCKASGYTFTDYNVDWVRQARGQRLEWIGDINPNNGGTIYAQKFQERVTITVDKSTSTAYMELSSLRSEDTAVYYCARNYRWFGAMDHWGQGTTVTVSS

SEQ ID NO: 36868 - protein, 5 aa, Artificial Sequence
  Description of Artificial Sequence: Synthetic peptide
  hu22D2[LAG-3] vhCDR1
DYNVD

SEQ ID NO: 36869 - protein, 17 aa, Artificial Sequence
  Description of Artificial Sequence: Synthetic peptide
  hu22D2[LAG-3] vhCDR2
DINPNNGGTIYAQKFQE

SEQ ID NO: 36870 - protein, 10 aa, Artificial Sequence
  Description of Artificial Sequence: Synthetic peptide
  hu22D2[LAG-3] vhCDR3
NYRWFGAMDH

SEQ ID NO: 36871 - protein, 111 aa, Artificial Sequence
  Description of Artificial Sequence: Synthetic polypeptide
  hu22D2[LAG-3] variable light Chain
DIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIK

SEQ ID NO: 36872 - protein, 15 aa, Artificial Sequence
  Description of Artificial Sequence: Synthetic peptide
  hu22D2[LAG-3] vlCDR1
KASQSLDYEGDSDMN

SEQ ID NO: 36873 - protein, 7 aa, Artificial Sequence
  Description of Artificial Sequence: Synthetic peptide
  hu22D2[LAG-3] vlCDR2
GASNLES

SEQ ID NO: 36874 - protein, 9 aa, Artificial Sequence
  Description of Artificial Sequence: Synthetic peptide
  hu22D2[LAG-3] vlCDR3
QQSTEDPRT

SEQ ID NO: 36875 - protein, 123 aa, Artificial Sequence
  Description of Artificial Sequence: Synthetic polypeptide
  H4sH15482P[LAG-3] variable heavy Chain
QVQLVESGGGVVQPGRSLRLSCVASGFTFSSYGMHWVRQAPGKGLEWVAIIWYDGSNKYYADSVKGRFTISRDNSKNTQYLQMNSLRAEDTAVYYCASVATSGDFDYYGMDVWGQGTTVTVSS

SEQ ID NO: 36876 - protein, 5 aa, Artificial Sequence
  Description of Artificial Sequence: Synthetic peptide
  H4sH15482P[LAG-3] vhCDR1
SYGMH

SEQ ID NO: 36877 - protein, 17 aa, Artificial Sequence
  Description of Artificial Sequence: Synthetic peptide
  H4sH15482P[LAG-3] vhCDR2
IIWYDGSNKYYADSVKG

SEQ ID NO: 36878 - protein, 14 aa, Artificial Sequence
  Description of Artificial Sequence: Synthetic peptide
  H4sH15482P[LAG-3] vhCDR3
VATSGDFDYYGMDV

SEQ ID NO: 36879 - protein, 107 aa, Artificial Sequence
  Description of Artificial Sequence: Synthetic polypeptide
  H4sH15482P[LAG-3] variable light Chain
EIVLTQSPATLSLSPGERTTLSCRASQRISTYLAWYQQKPGQAPRLLIYDASKRATGIPARFSGSGSGTGFTLTISSLEPEDFAVYYCQQRSNWPLTFGGGTKVEIK

SEQ ID NO: 36880 - protein, 11 aa, Artificial Sequence
  Description of Artificial Sequence: Synthetic peptide
  H4sH15482P[LAG-3] vlCDR1
RASQRISTYLA

SEQ ID NO: 36881 - protein, 7 aa, Artificial Sequence
  Description of Artificial Sequence: Synthetic peptide
  H4sH15482P[LAG-3] vlCDR2
DASKRAT

SEQ ID NO: 36882 - protein, 9 aa, Artificial Sequence
  Description of Artificial Sequence: Synthetic peptide
  H4sH15482P[LAG-3] vlCDR3
QQRSNWPLT

SEQ ID NO: 36883 - protein, 119 aa, Artificial Sequence
  Description of Artificial Sequence: Synthetic polypeptide
  L35D4[LAG-3] variable heavy Chain
QVQLVQSGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 36884 - protein, 5 aa, Artificial Sequence
  Description of Artificial Sequence: Synthetic peptide
  L35D4[LAG-3] vhCDR1
SYYMH

SEQ ID NO: 36885 - protein, 17 aa, Artificial Sequence
  Description of Artificial Sequence: Synthetic peptide
  L35D4[LAG-3] vhCDR2
IINPSAGSTSYAQKFQG

SEQ ID NO: 36886 - protein, 10 aa, Artificial Sequence
  Description of Artificial Sequence: Synthetic peptide
  L35D4[LAG-3] vhCDR3
ELMATGGFDY

SEQ ID NO: 36887 - protein, 112 aa, Artificial Sequence
  Description of Artificial Sequence: Synthetic polypeptide
  L35D4[LAG-3] variable light Chain
QSVLTQPPSASGSPGQSVTISCTGTSSDVGGYNYVSWYQQYPGKAPRLMIFEVTERASGVPDRFSGSKSGNTASLTVSGLQTEDEAVYFCSSYSGSNNPGAMFGGGTKLTVL

SEQ ID NO: 36888 - protein, 14 aa, Artificial Sequence
  Description of Artificial Sequence: Synthetic peptide
  L35D4[LAG-3] vlCDR1
TGTSSDVGGYNYVS

SEQ ID NO: 36889 - protein, 7 aa, Artificial Sequence
  Description of Artificial Sequence: Synthetic peptide
  L35D4[LAG-3] vlCDR2
EVTERAS

SEQ ID NO: 36890 - protein, 12 aa, Artificial Sequence
  Description of Artificial Sequence: Synthetic peptide
  L35D4[LAG-3] vlCDR3
SSYSGSNNPGAM

SEQ ID NO: 36891 - protein, 119 aa, Artificial Sequence; identical to SEQ ID NO: 36883
  Description of Artificial Sequence: Synthetic polypeptide
  L35G6[LAG-3] variable heavy Chain

SEQ ID NO: 36892 - protein, 5 aa, Artificial Sequence
  Description of Artificial Sequence: Synthetic peptide
  L35G6[LAG-3] vhCDR1
SYYMH

SEQ ID NO: 36893 - protein, 17 aa, Artificial Sequence
  Description of Artificial Sequence: Synthetic peptide
  L35G6[LAG-3] vhCDR2
IINPSAGSTSYAQKFQG

SEQ ID NO: 36894 - protein, 10 aa, Artificial Sequence
  Description of Artificial Sequence: Synthetic peptide
  L35G6[LAG-3] vhCDR3
ELMATGGFDY

SEQ ID NO: 36895 - protein, 110 aa, Artificial Sequence
  Description of Artificial Sequence: Synthetic polypeptide
  L35G6[LAG-3] variable light Chain
QAGLTQPASVSGSPGQSITISCTGSSSDVGGYSYVSWYQKHPGKAPKLMIYDVTNRPSGVSNRFSGSKSGNTASLTISGLQAEDEADYYCSTYTRSNTLVFGPGTKVTVL

SEQ ID NO: 36896 - protein, 14 aa, Artificial Sequence
  Description of Artificial Sequence: Synthetic peptide
  L35G6[LAG-3] vlCDR1
TGSSSDVGGYSYVS

SEQ ID NO: 36897 - protein, 7 aa, Artificial Sequence
  Description of Artificial Sequence: Synthetic peptide
  L35G6[LAG-3] vlCDR2
DVTNRPS

SEQ ID NO: 36898 - protein, 10 aa, Artificial Sequence
  Description of Artificial Sequence: Synthetic peptide
  L35G6[LAG-3] vlCDR3
STYTRSNTLV

SEQ ID NO: 36899 - protein, 119 aa, Artificial Sequence; identical to SEQ ID NO: 36883
  Description of Artificial Sequence: Synthetic polypeptide
  L33H11[LAG-3] variable heavy Chain

SEQ ID NO: 36900 - protein, 5 aa, Artificial Sequence
  Description of Artificial Sequence: Synthetic peptide
  L33H11[LAG-3] vhCDR1
SYYMH

SEQ ID NO: 36901 - protein, 17 aa, Artificial Sequence
  Description of Artificial Sequence: Synthetic peptide
  L33H11[LAG-3] vhCDR2
IINPSAGSTSYAQKFQG

SEQ ID NO: 36902 - protein, 10 aa, Artificial Sequence
  Description of Artificial Sequence: Synthetic peptide
  L33H11[LAG-3] vhCDR3
ELMATGGFDY

SEQ ID NO: 36903 - protein, 110 aa, Artificial Sequence
  Description of Artificial Sequence: Synthetic polypeptide
  L33H11[LAG-3] variable light Chain
LPVLTQPASVSGSPGQSITISCTGTSSDVGGYNYVSWYQQHPGKAPKLMIYDVTNRPSGVSNRFSGSKSGNTASLTISGLQAEDEADYYCSSYTSSNTLLFGGGTQLTVL

SEQ ID NO: 36904 - protein, 14 aa, Artificial Sequence
  Description of Artificial Sequence: Synthetic peptide
  L33H11[LAG-3] vlCDR1
TGTSSDVGGYNYVS

SEQ ID NO: 36905 - protein, 7 aa, Artificial Sequence
  Description of Artificial Sequence: Synthetic peptide
  L33H11[LAG-3] vlCDR2
DVTNRPS

SEQ ID NO: 36906 - protein, 10 aa, Artificial Sequence
  Description of Artificial Sequence: Synthetic peptide
  L33H11[LAG-3] vlCDR3
SSYTSSNTLL

SEQ ID NO: 36907 - protein, 119 aa, Artificial Sequence; identical to SEQ ID NO: 36883
  Description of Artificial Sequence: Synthetic polypeptide
  L32A9[LAG-3] variable heavy Chain

SEQ ID NO: 36908 - protein, 5 aa, Artificial Sequence
  Description of Artificial Sequence: Synthetic peptide
  L32A9[LAG-3] vhCDR1
SYYMH

SEQ ID NO: 36909 - protein, 17 aa, Artificial Sequence
  Description of Artificial Sequence: Synthetic peptide
  L32A9[LAG-3] vhCDR2
IINPSAGSTSYAQKFQG

SEQ ID NO: 36910 - protein, 10 aa, Artificial Sequence
  Description of Artificial Sequence: Synthetic peptide
  L32A9[LAG-3] vhCDR3
ELMATGGFDY

SEQ ID NO: 36911 - protein, 110 aa, Artificial Sequence
  Description of Artificial Sequence: Synthetic polypeptide
  L32A9[LAG-3] variable light Chain
QSVVTQPPSVSAAPGQKVTISCSGSSSNIGNNYVSWYQQLPGTAPKLLIYDNNKRHSGIPDRFSGSTSDTSATLGITRLQTGDEADYYCGTWDSSLSAYVFGTGTKVTVL

SEQ ID NO: 36912 - protein, 13 aa, Artificial Sequence
  Description of Artificial Sequence: Synthetic peptide
  L32A9[LAG-3] vlCDR1
SGSSSNIGNNYVS

SEQ ID NO: 36913 - protein, 7 aa, Artificial Sequence
  Description of Artificial Sequence: Synthetic peptide
  L32A9[LAG-3] vlCDR2
DNNKRHS

SEQ ID NO: 36914 - protein, 11 aa, Artificial Sequence
  Description of Artificial Sequence: Synthetic peptide
  L32A9[LAG-3] vlCDR3
GTWDSSLSAYV

SEQ ID NO: 36915 - protein, 119 aa, Artificial Sequence; identical to SEQ ID NO: 36883
  Description of Artificial Sequence: Synthetic polypeptide
  L32D10[LAG-3] variable heavy Chain

SEQ ID NO: 36916 - protein, 5 aa, Artificial Sequence
  Description of Artificial Sequence: Synthetic peptide
  L32D10[LAG-3] vhCDR1
SYYMH

SEQ ID NO: 36917 - protein, 17 aa, Artificial Sequence
  Description of Artificial Sequence: Synthetic peptide
  L32D10[LAG-3] vhCDR2
IINPSAGSTSYAQKFQG

SEQ ID NO: 36918 - protein, 10 aa, Artificial Sequence
  Description of Artificial Sequence: Synthetic peptide
  L32D10[LAG-3] vhCDR3
ELMATGGFDY

SEQ ID NO: 36919 - protein, 110 aa, Artificial Sequence
  Description of Artificial Sequence: Synthetic polypeptide
  L32D10[LAG-3] variable light Chain
QSVLTQPPSASGSPGQSVTISCTGTSSDVGGYDYVSWYQQHQGKAPKLMIYDVSNRPSGVSNRFSGSKSGNTASLTISGLQAEDEADYYCSSYTSSTTLVFGGGTKLTVL

SEQ ID NO: 36920 - protein, 14 aa, Artificial Sequence
  Description of Artificial Sequence: Synthetic peptide
  L32D10[LAG-3] vlCDR1
TGTSSDVGGYDYVS

SEQ ID NO: 36921 - protein, 7 aa, Artificial Sequence
  Description of Artificial Sequence: Synthetic peptide
  L32D10[LAG-3] vlCDR2
DVSNRPS

SEQ ID NO: 36922 - protein, 10 aa, Artificial Sequence
  Description of Artificial Sequence: Synthetic peptide
  L32D10[LAG-3] vlCDR3
SSYTSSTTLV

SEQ ID NO: 36923 - protein, 119 aa, Artificial Sequence; identical to SEQ ID NO: 36883
  Description of Artificial Sequence: Synthetic polypeptide
  L32A4[LAG-3] variable heavy Chain

SEQ ID NO: 36924 - protein, 5 aa, Artificial Sequence
  Description of Artificial Sequence: Synthetic peptide
  L32A4[LAG-3] vhCDR1
SYYMH

SEQ ID NO: 36925 - protein, 17 aa, Artificial Sequence
  Description of Artificial Sequence: Synthetic peptide
  L32A4[LAG-3] vhCDR2
IINPSAGSTSYAQKFQG

SEQ ID NO: 36926 - protein, 10 aa, Artificial Sequence
  Description of Artificial Sequence: Synthetic peptide
  L32A4[LAG-3] vhCDR3
ELMATGGFDY

SEQ ID NO: 36927 - protein, 110 aa, Artificial Sequence
  Description of Artificial Sequence: Synthetic polypeptide
  L32A4[LAG-3] variable light Chain
QSVLTQPASVSGSPGQSITISCTGTSSDIGAYNFVSWYQQHPGKAPKLMIYGVSNRPSGVSSRFSGSKSGSTASLTISGLQAEDEADYYCSSYTTSGSAVFGTGTKLTVL

SEQ ID NO: 36928 - protein, 14 aa, Artificial Sequence
  Description of Artificial Sequence: Synthetic peptide
  L32A4[LAG-3] vlCDR1
TGTSSDIGAYNFVS

SEQ ID NO: 36929 - protein, 7 aa, Artificial Sequence
  Description of Artificial Sequence: Synthetic peptide
  L32A4[LAG-3] vlCDR2
GVSNRPS

SEQ ID NO: 36930 - protein, 10 aa, Artificial Sequence
  Description of Artificial Sequence: Synthetic peptide
  L32A4[LAG-3] vlCDR3
SSYTTSGSAV

SEQ ID NO: 36931 - protein, 119 aa, Artificial Sequence
  Description of Artificial Sequence: Synthetic polypeptide
  L3A1[LAG-3] variable heavy Chain
EVQLLESGAEVKKPGASVKVSCKASGYTFTSYYMHWVRQAPGQGLEWMGIINPSAGSTSYAQKFQGRVTMTRDTSTSTVYMELSSLRSEDTAVYYCARELMATGGFDYWGQGTLVTVSS

SEQ ID NO: 36932 - protein, 5 aa, Artificial Sequence
  Description of Artificial Sequence: Synthetic peptide
  L3A1[LAG-3] vhCDR1
SYYMH

SEQ ID NO: 36933 - protein, 17 aa, Artificial Sequence
  Description of Artificial Sequence: Synthetic peptide
  L3A1[LAG-3] vhCDR2
IINPSAGSTSYAQKFQG

SEQ ID NO: 36934 - protein, 10 aa, Artificial Sequence
  Description of Artificial Sequence: Synthetic peptide
  L3A1[LAG-3] vhCDR3
ELMATGGFDY

SEQ ID NO: 36935 - protein, 110 aa, Artificial Sequence
  Description of Artificial Sequence: Synthetic polypeptide
  L3A1[LAG-3] variable light Chain
QSVLTQPASVSGSPGQSITISCTGTSSDIGAYNFVSWYQQHPGKAPKLMIYGVSNRPSGVSSRFSGSKSGSTASLTITGLQAEDEADYYCSSYTTSGSAVFGTGTKLTVL

SEQ ID NO: 36936 - protein, 14 aa, Artificial Sequence
  Description of Artificial Sequence: Synthetic peptide
  L3A1[LAG-3] vlCDR1
TGTSSDIGAYNFVS

SEQ ID NO: 36937 - protein, 7 aa, Artificial Sequence
  Description of Artificial Sequence: Synthetic peptide
  L3A1[LAG-3] vlCDR2
GVSNRPS

SEQ ID NO: 36938 - protein, 10 aa, Artificial Sequence
  Description of Artificial Sequence: Synthetic peptide
  L3A1[LAG-3] vlCDR3
SSYTTSGSAV

SEQ ID NO: 36939 - protein, 121 aa, Artificial Sequence
  Description of Artificial Sequence: Synthetic polypeptide
  L3A10[LAG-3] variable heavy Chain
EVQLLESGGGVVQPGRSLRVSCAASGFTFSNHAMHWVRQAPGKGLEWVAVISYDGSKKFYSDSVRGRFTISRDNSKNTLYLQMNSLRPEDTAVYYCAKGAHGYTSGWHDYWGQGTLVTVSS

SEQ ID NO: 36940 - protein, 5 aa, Artificial Sequence
  Description of Artificial Sequence: Synthetic peptide
  L3A10[LAG-3] vhCDR1
NHAMH

SEQ ID NO: 36941 - protein, 17 aa, Artificial Sequence
  Description of Artificial Sequence: Synthetic peptide
  L3A10[LAG-3] vhCDR2
VISYDGSKKFYSDSVRG

SEQ ID NO: 36942 - protein, 12 aa, Artificial Sequence
  Description of Artificial Sequence: Synthetic peptide
  L3A10[LAG-3] vhCDR3
GAHGYTSGWHDY

SEQ ID NO: 36943 - protein, 108 aa, Artificial Sequence
  Description of Artificial Sequence: Synthetic polypeptide
  L3A10[LAG-3] variable light Chain
DVVMTQSPSSLSASVGDRVSITCRASQNIGRYLNWYQQKPGKAPKLLVSAASSLQGGVPSRFSGSGSGTDFTLTISRLQPEDFATYFCQQTYSSPQCTFGQGTKVDIK

SEQ ID NO: 36944 - protein, 11 aa, Artificial Sequence
  Description of Artificial Sequence: Synthetic peptide
  L3A10[LAG-3] vlCDR1
RASQNIGRYLN

SEQ ID NO: 36945 - protein, 7 aa, Artificial Sequence
  Description of Artificial Sequence: Synthetic peptide
  L3A10[LAG-3] vlCDR2
AASSLQG

SEQ ID NO: 36946 - protein, 10 aa, Artificial Sequence
  Description of Artificial Sequence: Synthetic peptide
  L3A10[LAG-3] vlCDR3
QQTYSSPQCT

SEQ ID NO: 36947 - protein, 121 aa, Artificial Sequence
  Description of Artificial Sequence: Synthetic polypeptide
  L3C5[LAG-3] variable heavy Chain
QVQLVQSGSELKKPGASVKVSCKASGYTFTNYYMHWVRQAPGQGLEWMGIINPSGGATNYAQKFQGRVTMTRDTSTSTVYMELSSLRSEDTAVYYCARDSGYDLGYGMDVWGQGTLVTVSS

SEQ ID NO: 36948 - protein, 5 aa, Artificial Sequence
  Description of Artificial Sequence: Synthetic peptide
  L3C5[LAG-3] vhCDR1
NYYMH

SEQ ID NO: 36949 - protein, 17 aa, Artificial Sequence
  Description of Artificial Sequence: Synthetic peptide
  L3C5[LAG-3] vhCDR2
IINPSGGATNYAQKFQG

SEQ ID NO: 36950 - protein, 12 aa, Artificial Sequence
  Description of Artificial Sequence: Synthetic peptide
  L3C5[LAG-3] vhCDR3
DSGYDLGYGMDV

SEQ ID NO: 36951 - protein, 110 aa, Artificial Sequence
  Description of Artificial Sequence: Synthetic polypeptide
  L3C5[LAG-3] variable light Chain
QSVLTQPASVSGSPGQSITISCTGTSSDVGGYNYVSWYQQHPGKAPKLMIYDVSNRPSGASNRFSGSKSGNTASLTISGLQAEDEADYYCSSYTNRNTLLFGGGTKLTVL

SEQ ID NO: 36952 - protein, 14 aa, Artificial Sequence
  Description of Artificial Sequence: Synthetic peptide
  L3C5[LAG-3] vlCDR1
TGTSSDVGGYNYVS

SEQ ID NO: 36953 - protein, 7 aa, Artificial Sequence
  Description of Artificial Sequence: Synthetic peptide
  L3C5[LAG-3] vlCDR2
DVSNRPS

SEQ ID NO: 36954 - protein, 10 aa, Artificial Sequence
  Description of Artificial Sequence: Synthetic peptide
  L3C5[LAG-3] vlCDR3
SSYTNRNTLL

SEQ ID NO: 36955 - protein, 119 aa, Artificial Sequence; identical to SEQ ID NO: 36931
  Description of Artificial Sequence: Synthetic polypeptide
  L3E3[LAG-3] variable heavy Chain

SEQ ID NO: 36956 - protein, 5 aa, Artificial Sequence
  Description of Artificial Sequence: Synthetic peptide
  L3E3[LAG-3] vhCDR1
SYYMH

SEQ ID NO: 36957 - protein, 17 aa, Artificial Sequence
  Description of Artificial Sequence: Synthetic peptide
  L3E3[LAG-3] vhCDR2
IINPSAGSTSYAQKFQG

SEQ ID NO: 36958 - protein, 10 aa, Artificial Sequence
  Description of Artificial Sequence: Synthetic peptide
  L3E3[LAG-3] vhCDR3
ELMATGGFDY

SEQ ID NO: 36959 - protein, 110 aa, Artificial Sequence
  Description of Artificial Sequence: Synthetic polypeptide
  L3E3[LAG-3] variable light Chain
QSVLTQPASASGSPGQSITISCTGTSSDVGGYNYVSWYQQHPGKAPKLMIYDVSNRPSGVSNRFSGSKSGNTASLTISGLQAEDEANYYCSSYTSSSTNVFGTGTKVTVL

SEQ ID NO: 36960 - protein, 14 aa, Artificial Sequence
  Description of Artificial Sequence: Synthetic peptide
  L3E3[LAG-3] vlCDR1
TGTSSDVGGYNYVS

SEQ ID NO: 36961 - protein, 7 aa, Artificial Sequence
  Description of Artificial Sequence: Synthetic peptide
  L3E3[LAG-3] vlCDR2
DVSNRPS

SEQ ID NO: 36962 - protein, 10 aa, Artificial Sequence
  Description of Artificial Sequence: Synthetic peptide
  L3E3[LAG-3] vlCDR3
SSYTSSSTNV

SEQ ID NO: 36963 - protein, 121 aa, Artificial Sequence
  Description of Artificial Sequence: Synthetic polypeptide
  durvalumab[PD-L1] variable heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 36964 - protein, 5 aa, Artificial Sequence
  Description of Artificial Sequence: Synthetic peptide
  durvalumab[PD-L1] vhCDR1
RYWMS

SEQ ID NO: 36965 - protein, 17 aa, Artificial Sequence
  Description of Artificial Sequence: Synthetic peptide
  durvalumab[PD-L1] vhCDR2
NIKQDGSEKYYVDSVKG

SEQ ID NO: 36966 - protein, 12 aa, Artificial Sequence
  Description of Artificial Sequence: Synthetic peptide
  durvalumab[PD-L1] vhCDR3
EGGWFGELAFDY

SEQ ID NO: 36967 - protein, 108 aa, Artificial Sequence
  Description of Artificial Sequence: Synthetic polypeptide
  durvalumab[PD-L1] variable light Chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 36968 - protein, 12 aa, Artificial Sequence
  Description of Artificial Sequence: Synthetic peptide
  durvalumab[PD-L1] vlCDR1
RASQRVSSSYLA

SEQ ID NO: 36969 - protein, 7 aa, Artificial Sequence
  Description of Artificial Sequence: Synthetic peptide
  durvalumab[PD-L1] vlCDR2
DASSRAT

SEQ ID NO: 36970 - protein, 9 aa, Artificial Sequence
  Description of Artificial Sequence: Synthetic peptide
  durvalumab[PD-L1] vlCDR3
QQYGSLPWT

SEQ ID NO: 36971 - protein, 118 aa, Artificial Sequence
  Description of Artificial Sequence: Synthetic polypeptide
  atezolizumab[PD-L1] variable heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 36972 - protein, 5 aa, Artificial Sequence
  Description of Artificial Sequence: Synthetic peptide
  atezolizumab[PD-L1] vhCDR1
DSWIH

SEQ ID NO: 36973 - protein, 17 aa, Artificial Sequence
  Description of Artificial Sequence: Synthetic peptide
  atezolizumab[PD-L1] vhCDR2
WISPYGGSTYYADSVKG

SEQ ID NO: 36974 - protein, 9 aa, Artificial Sequence
  Description of Artificial Sequence: Synthetic peptide
  atezolizumab[PD-L1] vhCDR3
RHWPGGFDY

SEQ ID NO: 36975 - protein, 108 aa, Artificial Sequence
  Description of Artificial Sequence: Synthetic polypeptide
  atezolizumab[PD-L1] variable light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 36976 - protein, 11 aa, Artificial Sequence
  Description of Artificial Sequence: Synthetic peptide
  atezolizumab[PD-L1] vlCDR1
RASQDVSTAVA

SEQ ID NO: 36977 - protein, 7 aa, Artificial Sequence
  Description of Artificial Sequence: Synthetic peptide
  atezolizumab[PD-L1] vlCDR2
SASFLYS

SEQ ID NO: 36978 - protein, 9 aa, Artificial Sequence
  Description of Artificial Sequence: Synthetic peptide
  atezolizumab[PD-L1] vlCDR3
QQYLYHPAT

SEQ ID NO: 36979 - protein, 120 aa, Artificial Sequence
  Description of Artificial Sequence: Synthetic polypeptide
  A09-246-2[PD-L1] variable heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 36980 - protein, 5 aa, Artificial Sequence
  Description of Artificial Sequence: Synthetic peptide
  A09-246-2[PD-L1] vhCDR1
SYIMM

SEQ ID NO: 36981 - protein, 17 aa, Artificial Sequence
  Description of Artificial Sequence: Synthetic peptide
  A09-246-2[PD-L1] vhCDR2
SIYPSGGITFYADTVKG

SEQ ID NO: 36982 - protein, 11 aa, Artificial Sequence
  Description of Artificial Sequence: Synthetic peptide
  A09-246-2[PD-L1] vhCDR3
IKLGTVTTVDY

SEQ ID NO: 36983 - protein, 110 aa, Artificial Sequence
  Description of Artificial Sequence: Synthetic polypeptide
  A09-246-2[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 36984 - protein, 14 aa, Artificial Sequence
  Description of Artificial Sequence: Synthetic peptide
  A09-246-2[PD-L1] vlCDR1
TGTSSDVGGYNYVS

SEQ ID NO: 36985 - protein, 7 aa, Artificial Sequence
  Description of Artificial Sequence: Synthetic peptide
  A09-246-2[PD-L1] vlCDR2
DVSNRPS

SEQ ID NO: 36986 - protein, 10 aa, Artificial Sequence
  Description of Artificial Sequence: Synthetic peptide
  A09-246-2[PD-L1] vlCDR3
SSYTSSSTRV

SEQ ID NO: 36987 - protein, 123 aa, Artificial Sequence
  Description of Artificial Sequence: Synthetic polypeptide
  12A4[PD-L1] variable heavy Chain
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 36988 - protein, 5 aa, Artificial Sequence
  Description of Artificial Sequence: Synthetic peptide
  12A4[PD-L1] vhCDR1
TYAIS

SEQ ID NO: 36989 - protein, 17 aa, Artificial Sequence
  Description of Artificial Sequence: Synthetic peptide
  12A4[PD-L1] vhCDR2
GIIPIFGKAHYAQKFQG

SEQ ID NO: 36990 - protein, 14 aa, Artificial Sequence
  Description of Artificial Sequence: Synthetic peptide
  12A4[PD-L1] vhCDR3
KFHFVSGSPFGMDV

SEQ ID NO: 36991 - protein, 106 aa, Artificial Sequence
  Description of Artificial Sequence: Synthetic polypeptide
  12A4[PD-L1] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 36992 - protein, 11 aa, Artificial Sequence
  Description of Artificial Sequence: Synthetic peptide
  12A4[PD-L1] vlCDR1
RASQSVSSYLA

SEQ ID NO: 36993 - protein, 7 aa, Artificial Sequence
  Description of Artificial Sequence: Synthetic peptide
  12A4[PD-L1] vlCDR2
DASNRAT

SEQ ID NO: 36994 - protein, 8 aa, Artificial Sequence
  Description of Artificial Sequence: Synthetic peptide
  12A4[PD-L1] vlCDR3
QQRSNWPT

SEQ ID NO: 36995 - protein, 117 aa, Artificial Sequence
  Description of Artificial Sequence: Synthetic polypeptide
  3G10[PD-L1] variable heavy Chain
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 36996 - protein, 5 aa, Artificial Sequence
  Description of Artificial Sequence: Synthetic peptide
  3G10[PD-L1] vhCDR1
DYGFS

SEQ ID NO: 36997 - protein, 17 aa, Artificial Sequence
  Description of Artificial Sequence: Synthetic peptide
  3G10[PD-L1] vhCDR2
WITAYNGNTNYAQKLQG

SEQ ID NO: 36998 - protein, 8 aa, Artificial Sequence
  Description of Artificial Sequence: Synthetic peptide
  3G10[PD-L1] vhCDR3
DYFYGMDV

SEQ ID NO: 36999 - protein, 107 aa, Artificial Sequence
  Description of Artificial Sequence: Synthetic polypeptide
  3G10[PD-L1] variable light Chain
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 37000 - protein, 11 aa, Artificial Sequence
  Description of Artificial Sequence: Synthetic peptide
  3G10[PD-L1] vlCDR1
RASQSVSSYLV

SEQ ID NO: 37001 - protein, 7 aa, Artificial Sequence
  Description of Artificial Sequence: Synthetic peptide
  3G10[PD-L1] vlCDR2
DASNRAT

SEQ ID NO: 37002 - protein, 9 aa, Artificial Sequence
  Description of Artificial Sequence: Synthetic peptide
  3G10[PD-L1] vlCDR3
QQRSNWPRT

SEQ ID NO: 37003 - protein, 118 aa, Artificial Sequence
  Description of Artificial Sequence: Synthetic polypeptide
  10A5[PD-L1] variable heavy Chain
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 37004 - protein, 5 aa, Artificial Sequence
  Description of Artificial Sequence: Synthetic peptide
  10A5[PD-L1] vhCDR1
SYDVH

SEQ ID NO: 37005 - protein, 17 aa, Artificial Sequence
  Description of Artificial Sequence: Synthetic peptide
  10A5[PD-L1] vhCDR2
WLHADTGITKFSQKFQG

SEQ ID NO: 37006 - protein, 9 aa, Artificial Sequence
  Description of Artificial Sequence: Synthetic peptide
  10A5[PD-L1] vhCDR3
ERIQLWFDY

SEQ ID NO: 37007 - protein, 107 aa, Artificial Sequence
  Description of Artificial Sequence: Synthetic polypeptide
  10A5[PD-L1] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 37008 - protein, 11 aa, Artificial Sequence
  Description of Artificial Sequence: Synthetic peptide
  10A5[PD-L1] vlCDR1
RASQGISSWLA

SEQ ID NO: 37009 - protein, 7 aa, Artificial Sequence
  Description of Artificial Sequence: Synthetic peptide
  10A5[PD-L1] vlCDR2
AASSLQS

SEQ ID NO: 37010 - protein, 9 aa, Artificial Sequence
  Description of Artificial Sequence: Synthetic peptide
  10A5[PD-L1] vlCDR3
QQYNSYPYT

SEQ ID NO: 37011 - protein, 114 aa, Artificial Sequence
  Description of Artificial Sequence: Synthetic polypeptide
  h3D10 Var 1[PD-L1] variable heavy Chain
QVQLVQSGAEVKKPGASVKVSCKASGYTFPDYYMNWVRQAPGQGLEWMGDIDPNYGGTNYAQKFQGRVTMTRDTSISTAYMELSRLRSDDTAVYYCARGALTDWGQGTMVTVSS

SEQ ID NO: 37012 - protein, 5 aa, Artificial Sequence
  Description of Artificial Sequence: Synthetic peptide
  h3D10 Var 1[PD-L1] vhCDR1
DYYMN

SEQ ID NO: 37013 - protein, 17 aa, Artificial Sequence
  Description of Artificial Sequence: Synthetic peptide
  h3D10 Var 1[PD-L1] vhCDR2
DIDPNYGGTNYAQKFQG

SEQ ID NO: 37014 - protein, 5 aa, Artificial Sequence
  Description of Artificial Sequence: Synthetic peptide
  h3D10 Var 1[PD-L1] vhCDR3
GALTD

SEQ ID NO: 37015 - protein, 106 aa, Artificial Sequence
  Description of Artificial Sequence: Synthetic polypeptide
  h3D10 Var 1[PD-L1] variable light Chain
EIVLTQSPATLSLSPGERATLSCRASSSVSYIYWFQQKPGQAPRLLIYAAFNRATGIPARFSGSGSGTDYTLTISSLEPEDFAVYYCQQWSNNPLTFGQGTKVEIK

SEQ ID NO: 37016 - protein, 10 aa, Artificial Sequence
  Description of Artificial Sequence: Synthetic peptide
  h3D10 Var 1[PD-L1] vlCDR1
RASSSVSYIY

SEQ ID NO: 37017 - protein, 7 aa, Artificial Sequence
  Description of Artificial Sequence: Synthetic peptide
  h3D10 Var 1[PD-L1] vlCDR2
AAFNRAT

SEQ ID NO: 37018 - protein, 9 aa, Artificial Sequence
  Description of Artificial Sequence: Synthetic peptide
  h3D10 Var 1[PD-L1] vlCDR3
QQWSNNPLT

SEQ ID NO: 37019 - protein, 114 aa, Artificial Sequence
  Description of Artificial Sequence: Synthetic polypeptide
  h3D10 Var 2[PD-L1] variable heavy Chain
QVQLVQSGAEVKKPGASVKVSCKASGYTFPDYYMNWVRQAPGQSLEWMGDIDPNYGGTNYNQKFQGRVTMTRDTSISTAYMELSRLRSDDTAVYYCARGALTDWGQGTMVTVSS

SEQ ID NO: 37020 - protein, 5 aa, Artificial Sequence
  Description of Artificial Sequence: Synthetic peptide
  h3D10 Var 2[PD-L1] vhCDR1
DYYMN

SEQ ID NO: 37021 - protein, 17 aa, Artificial Sequence
  Description of Artificial Sequence: Synthetic peptide
  h3D10 Var 2[PD-L1] vhCDR2
DIDPNYGGTNYNQKFQG

SEQ ID NO: 37022 - protein, 5 aa, Artificial Sequence
  Description of Artificial Sequence: Synthetic peptide
  h3D10 Var 2[PD-L1] vhCDR3
GALTD

SEQ ID NO: 37023 - protein, 106 aa, Artificial Sequence
  Description of Artificial Sequence: Synthetic polypeptide
  h3D10 Var 2[PD-L1] variable light Chain
EIVLTQSPATLSLSPGERATLSCRASSSVSYIYWFQQKPGQSPRPLIYAAFNRATGIPARFSGSGSGTDYTLTISSLEPEDFAVYYCQQWSNNPLTFGQGTKVEIK

SEQ ID NO: 37024 - protein, 10 aa, Artificial Sequence
  Description of Artificial Sequence: Synthetic peptide
  h3D10 Var 2[PD-L1] vlCDR1
RASSSVSYIY

SEQ ID NO: 37025 - protein, 7 aa, Artificial Sequence
  Description of Artificial Sequence: Synthetic peptide
  h3D10 Var 2[PD-L1] vlCDR2
AAFNRAT

SEQ ID NO: 37026 - protein, 9 aa, Artificial Sequence
  Description of Artificial Sequence: Synthetic peptide
  h3D10 Var 2[PD-L1] vlCDR3
QQWSNNPLT

SEQ ID NO: 37027 - protein, 114 aa, Artificial Sequence; identical to SEQ ID NO: 37019
  Description of Artificial Sequence: Synthetic polypeptide
  h3D10 Var 3[PD-L1] variable heavy Chain

SEQ ID NO: 37028 - protein, 5 aa, Artificial Sequence
  Description of Artificial Sequence: Synthetic peptide
  h3D10 Var 3[PD-L1] vhCDR1
DYYMN

SEQ ID NO: 37029 - protein, 17 aa, Artificial Sequence
  Description of Artificial Sequence: Synthetic peptide
  h3D10 Var 3[PD-L1] vhCDR2
DIDPNYGGTNYNQKFQG

SEQ ID NO: 37030 - protein, 5 aa, Artificial Sequence
  Description of Artificial Sequence: Synthetic peptide
  h3D10 Var 3[PD-L1] vhCDR3
GALTD

SEQ ID NO: 37031 - protein, 106 aa, Artificial Sequence
  Description of Artificial Sequence: Synthetic polypeptide
  h3D10 Var 3[PD-L1] variable light Chain
QIVLTQSPATLSLSPGERATLSCRASSSVSYIYWFQQKPGQSPRPLIYATFNLASGIPARFSGSGSGTSYTLTISRLEPEDFAVYYCQQWSNNPLTFGQGTKVEIK

SEQ ID NO: 37032 - protein, 10 aa, Artificial Sequence
  Description of Artificial Sequence: Synthetic peptide
  h3D10 Var 3[PD-L1] vlCDR1
RASSSVSYIY

SEQ ID NO: 37033 - protein, 7 aa, Artificial Sequence
  Description of Artificial Sequence: Synthetic peptide
  h3D10 Var 3[PD-L1] vlCDR2
ATFNLAS

SEQ ID NO: 37034 - protein, 9 aa, Artificial Sequence
  Description of Artificial Sequence: Synthetic peptide
  h3D10 Var 3[PD-L1] vlCDR3
QQWSNNPLT

SEQ ID NO: 37035 - protein, 114 aa, Artificial Sequence
  Description of Artificial Sequence: Synthetic polypeptide
  h3D10 Var 4[PD-L1] variable heavy Chain
EVQLVQSGAEVKKPGASVKVSCKASGYTFPDYYMNWVRQAPGQSLEWMGDIDPNYGGTNYNQKFQGRVTMTVDRSSSTAYMELSRLRSDDTAVYYCARGALTDWGQGTMVTVSS

SEQ ID NO: 37036 - protein, 5 aa, Artificial Sequence
  Description of Artificial Sequence: Synthetic peptide
  h3D10 Var 4[PD-L1] vhCDR1
DYYMN

SEQ ID NO: 37037 - protein, 17 aa, Artificial Sequence
  Description of Artificial Sequence: Synthetic peptide
  h3D10 Var 4[PD-L1] vhCDR2
DIDPNYGGTNYNQKFQG

SEQ ID NO: 37038 - protein, 5 aa, Artificial Sequence
  Description of Artificial Sequence: Synthetic peptide
  h3D10 Var 4[PD-L1] vhCDR3
GALTD

SEQ ID NO: 37039 - protein, 106 aa, Artificial Sequence; identical to SEQ ID NO: 37023
  Description of Artificial Sequence: Synthetic polypeptide
  h3D10 Var 4[PD-L1] variable light Chain

SEQ ID NO: 37040 - protein, 10 aa, Artificial Sequence
  Description of Artificial Sequence: Synthetic peptide
  h3D10 Var 4[PD-L1] vlCDR1
RASSSVSYIY

SEQ ID NO: 37041 - protein, 7 aa, Artificial Sequence
  Description of Artificial Sequence: Synthetic peptide
  h3D10 Var 4[PD-L1] vlCDR2
AAFNRAT

SEQ ID NO: 37042 - protein, 9 aa, Artificial Sequence
  Description of Artificial Sequence: Synthetic peptide
  h3D10 Var 4[PD-L1] vlCDR3
QQWSNNPLT

SEQ ID NO: 37043 - protein, 114 aa, Artificial Sequence; identical to SEQ ID NO: 37035
  Description of Artificial Sequence: Synthetic polypeptide
  h3D10 Var 5[PD-L1] variable heavy Chain

SEQ ID NO: 37044 - protein, 5 aa, Artificial Sequence
  Description of Artificial Sequence: Synthetic peptide
  h3D10 Var 5[PD-L1] vhCDR1
DYYMN

SEQ ID NO: 37045 - protein, 17 aa, Artificial Sequence
  Description of Artificial Sequence: Synthetic peptide
  h3D10 Var 5[PD-L1] vhCDR2
DIDPNYGGTNYNQKFQG

SEQ ID NO: 37046 - protein, 5 aa, Artificial Sequence
  Description of Artificial Sequence: Synthetic peptide
  h3D10 Var 5[PD-L1] vhCDR3
GALTD

SEQ ID NO: 37047 - protein, 106 aa, Artificial Sequence; identical to SEQ ID NO: 37031
  Description of Artificial Sequence: Synthetic polypeptide
  h3D10 Var 5[PD-L1] variable light Chain

SEQ ID NO: 37048 - protein, 10 aa, Artificial Sequence
  Description of Artificial Sequence: Synthetic peptide
  h3D10 Var 5[PD-L1] vlCDR1
RASSSVSYIY

SEQ ID NO: 37049 - protein, 7 aa, Artificial Sequence
  Description of Artificial Sequence: Synthetic peptide
  h3D10 Var 5[PD-L1] vlCDR2
ATFNLAS

SEQ ID NO: 37050 - protein, 9 aa, Artificial Sequence
  Description of Artificial Sequence: Synthetic peptide
  h3D10 Var 5[PD-L1] vlCDR3
QQWSNNPLT

SEQ ID NO: 37051 - protein, 114 aa, Artificial Sequence
  Description of Artificial Sequence: Synthetic polypeptide
  h3D10 Var 6[PD-L1] variable heavy Chain
EVQLVESGGGLVQPGRSLRLSCTASGYTFPDYYMNWVRQAPGKGLEWVGDIDPNYGGTTYAASVKGRFTISVDRSKSIAYLQMSSLKTEDTAVYYCTRGALTDWGQGTMVTVSS

SEQ ID NO: 37052 - protein, 5 aa, Artificial Sequence
  Description of Artificial Sequence: Synthetic peptide
  h3D10 Var 6[PD-L1] vhCDR1
DYYMN

SEQ ID NO: 37053 - protein, 17 aa, Artificial Sequence
  Description of Artificial Sequence: Synthetic peptide
  h3D10 Var 6[PD-L1] vhCDR2
DIDPNYGGTTYAASVKG

SEQ ID NO: 37054 - protein, 5 aa, Artificial Sequence
  Description of Artificial Sequence: Synthetic peptide
  h3D10 Var 6[PD-L1] vhCDR3
GALTD

SEQ ID NO: 37055 - protein, 106 aa, Artificial Sequence
  Description of Artificial Sequence: Synthetic polypeptide
  h3D10 Var 6[PD-L1] variable light Chain
DIQLTQSPSSLSASVGDRVTITCRASSGVSYIYWFQQKPGKAPKLLIYAAFNLASGVPSRFSGSGSGTEYTLTISSLQPEDFATYYCQQWSNNPLTFGQGTKVEIK

SEQ ID NO: 37056 - protein, 10 aa, Artificial Sequence
  Description of Artificial Sequence: Synthetic peptide
  h3D10 Var 6[PD-L1] vlCDR1
RASSGVSYIY

SEQ ID NO: 37057 - protein, 7 aa, Artificial Sequence
  Description of Artificial Sequence: Synthetic peptide
  h3D10 Var 6[PD-L1] vlCDR2
AAFNLAS

SEQ ID NO: 37058 - protein, 9 aa, Artificial Sequence
  Description of Artificial Sequence: Synthetic peptide
  h3D10 Var 6[PD-L1] vlCDR3
QQWSNNPLT

SEQ ID NO: 37059 - protein, 114 aa, Artificial Sequence
  Description of Artificial Sequence: Synthetic polypeptide
  h3D10 Var 7[PD-L1] variable heavy Chain
EVQLVESGGGLVQPGRSLRLSCTASGYTFPDYYMNWVRQAPGKGLEWVGDIDPNYGGTTYNASVKGRFTISVDRSKSIAYLQMSSLKTEDTAVYYCARGALTDWGQGTMVTVSS

SEQ ID NO: 37060 - protein, 5 aa, Artificial Sequence
  Description of Artificial Sequence: Synthetic peptide
  h3D10 Var 7[PD-L1] vhCDR1
DYYMN

SEQ ID NO: 37061 - protein, 17 aa, Artificial Sequence
  Description of Artificial Sequence: Synthetic peptide
  h3D10 Var 7[PD-L1] vhCDR2
DIDPNYGGTTYNASVKG

SEQ ID NO: 37062 - protein, 5 aa, Artificial Sequence
  Description of Artificial Sequence: Synthetic peptide
  h3D10 Var 7[PD-L1] vhCDR3
GALTD

SEQ ID NO: 37063 - protein, 106 aa, Artificial Sequence
  Description of Artificial Sequence: Synthetic polypeptide
  h3D10 Var 7[PD-L1] variable light Chain
DIQLTQSPSSLSASVGDRVTITCRASSGVSYIYWFQQKPGKAPKPLIYAAFNLASGVPSRFSGSGSGTEYTLTISSLQPEDFATYYCQQWSNNPLTFGQGTKVEIK

SEQ ID NO: 37064 - protein, 10 aa, Artificial Sequence
  Description of Artificial Sequence: Synthetic peptide
  h3D10 Var 7[PD-L1] vlCDR1
RASSGVSYIY

SEQ ID NO: 37065 - protein, 7 aa, Artificial Sequence
  Description of Artificial Sequence: Synthetic peptide
  h3D10 Var 7[PD-L1] vlCDR2
AAFNLAS

SEQ ID NO: 37066 - protein, 9 aa, Artificial Sequence
  Description of Artificial Sequence: Synthetic peptide
  h3D10 Var 7[PD-L1] vlCDR3
QQWSNNPLT

SEQ ID NO: 37067 - protein, 114 aa, Artificial Sequence; identical to SEQ ID NO: 37059
  Description of Artificial Sequence: Synthetic polypeptide
  h3D10 Var 8[PD-L1] variable heavy Chain

SEQ ID NO: 37068 - protein, 5 aa, Artificial Sequence
  Description of Artificial Sequence: Synthetic peptide
  h3D10 Var 8[PD-L1] vhCDR1
DYYMN

SEQ ID NO: 37069 - protein, 17 aa, Artificial Sequence
  Description of Artificial Sequence: Synthetic peptide
  h3D10 Var 8[PD-L1] vhCDR2
DIDPNYGGTTYNASVKG

SEQ ID NO: 37070 - protein, 5 aa, Artificial Sequence
  Description of Artificial Sequence: Synthetic peptide
  h3D10 Var 8[PD-L1] vhCDR3
GALTD

SEQ ID NO: 37071 - protein, 106 aa, Artificial Sequence
  Description of Artificial Sequence: Synthetic polypeptide
  h3D10 Var 8[PD-L1] variable light Chain
DIQLTQSPSILSASVGDRVTITCRASSSVSYIYWFQQKPGKAPKPLIYATFNLASGVPSRFSGSGSGTSYTLTISSLQPEDFATYYCQQWSNNPLTFGQGTKVEIK

SEQ ID NO: 37072 - protein, 10 aa, Artificial Sequence
  Description of Artificial Sequence: Synthetic peptide
  h3D10 Var 8[PD-L1] vlCDR1
RASSSVSYIY

SEQ ID NO: 37073 - protein, 7 aa, Artificial Sequence
  Description of Artificial Sequence: Synthetic peptide
  h3D10 Var 8[PD-L1] vlCDR2
ATFNLAS

SEQ ID NO: 37074 - protein, 9 aa, Artificial Sequence
  Description of Artificial Sequence: Synthetic peptide
  h3D10 Var 8[PD-L1] vlCDR3
QQWSNNPLT

SEQ ID NO: 37075 - protein, 114 aa, Artificial Sequence
  Description of Artificial Sequence: Synthetic polypeptide
  h3D10 Var 9[PD-L1] variable heavy Chain
EVQLVESGGGLVQPGRSLRLSCTASGYTFPDYYMNWVRQAPGKGLEWVGDIDPNYGGTTYNQSVKGRFTISVDRSKSIAYLQMSSLKTEDTAVYYCARGALTDWGQGTMVTVSS

SEQ ID NO: 37076 - protein, 5 aa, Artificial Sequence
  Description of Artificial Sequence: Synthetic peptide
  h3D10 Var 9[PD-L1] vhCDR1
DYYMN

SEQ ID NO: 37077 - protein, 17 aa, Artificial Sequence
  Description of Artificial Sequence: Synthetic peptide
  h3D10 Var 9[PD-L1] vhCDR2
DIDPNYGGTTYNQSVKG

SEQ ID NO: 37078 - protein, 5 aa, Artificial Sequence
  Description of Artificial Sequence: Synthetic peptide
  h3D10 Var 9[PD-L1] vhCDR3
GALTD

SEQ ID NO: 37079 - protein, 106 aa, Artificial Sequence; identical to SEQ ID NO: 37063
  Description of Artificial Sequence: Synthetic polypeptide
  h3D10 Var 9[PD-L1] variable light Chain

SEQ ID NO: 37080 - protein, 10 aa, Artificial Sequence
  Description of Artificial Sequence: Synthetic peptide
  h3D10 Var 9[PD-L1] vlCDR1
RASSGVSYIY

SEQ ID NO: 37081 - protein, 7 aa, Artificial Sequence
  Description of Artificial Sequence: Synthetic peptide
  h3D10 Var 9[PD-L1] vlCDR2
AAFNLAS

SEQ ID NO: 37082 - protein, 9 aa, Artificial Sequence
  Description of Artificial Sequence: Synthetic peptide
  h3D10 Var 9[PD-L1] vlCDR3
QQWSNNPLT

SEQ ID NO: 37083 - protein, 114 aa, Artificial Sequence; identical to SEQ ID NO: 37075
  Description of Artificial Sequence: Synthetic polypeptide
  h3D10 Var 10[PD-L1] variable heavy Chain

SEQ ID NO: 37084 - protein, 5 aa, Artificial Sequence
  Description of Artificial Sequence: Synthetic peptide
  h3D10 Var 10[PD-L1] vhCDR1
DYYMN

SEQ ID NO: 37085 - protein, 17 aa, Artificial Sequence
  Description of Artificial Sequence: Synthetic peptide
  h3D10 Var 10[PD-L1] vhCDR2
DIDPNYGGTTYNQSVKG

SEQ ID NO: 37086 - protein, 5 aa, Artificial Sequence
  Description of Artificial Sequence: Synthetic peptide
  h3D10 Var 10[PD-L1] vhCDR3
GALTD

SEQ ID NO: 37087 - protein, 106 aa, Artificial Sequence; identical to SEQ ID NO: 37071
  Description of Artificial Sequence: Synthetic polypeptide
  h3D10 Var 10[PD-L1] variable light Chain

SEQ ID NO: 37088 - protein, 10 aa, Artificial Sequence
  Description of Artificial Sequence: Synthetic peptide
  h3D10 Var 10[PD-L1] vlCDR1
RASSSVSYIY

SEQ ID NO: 37089 - protein, 7 aa, Artificial Sequence
  Description of Artificial Sequence: Synthetic peptide
  h3D10 Var 10[PD-L1] vlCDR2
ATFNLAS

SEQ ID NO: 37090 - protein, 9 aa, Artificial Sequence
  Description of Artificial Sequence: Synthetic peptide
  h3D10 Var 10[PD-L1] vlCDR3
QQWSNNPLT

SEQ ID NO: 37091 - protein, 114 aa, Artificial Sequence; identical to SEQ ID NO: 37051
  Description of Artificial Sequence: Synthetic polypeptide
  h3D10 Var 11[PD-L1] variable heavy Chain

SEQ ID NO: 37092 - protein, 5 aa, Artificial Sequence
  Description of Artificial Sequence: Synthetic peptide
  h3D10 Var 11[PD-L1] vhCDR1
DYYMN

SEQ ID NO: 37093 - protein, 17 aa, Artificial Sequence
  Description of Artificial Sequence: Synthetic peptide
  h3D10 Var 11[PD-L1] vhCDR2
DIDPNYGGTTYAASVKG

SEQ ID NO: 37094 - protein, 5 aa, Artificial Sequence
  Description of Artificial Sequence: Synthetic peptide
  h3D10 Var 11[PD-L1] vhCDR3
GALTD

SEQ ID NO: 37095 - protein, 106 aa, Artificial Sequence; identical to SEQ ID NO: 37015
  Description of Artificial Sequence: Synthetic polypeptide
  h3D10 Var 11[PD-L1] variable light Chain

SEQ ID NO: 37096 - protein, 10 aa, Artificial Sequence
  Description of Artificial Sequence: Synthetic peptide
  h3D10 Var 11[PD-L1] vlCDR1
RASSSVSYIY

SEQ ID NO: 37097 - protein, 7 aa, Artificial Sequence
  Description of Artificial Sequence: Synthetic peptide
  h3D10 Var 11[PD-L1] vlCDR2
AAFNRAT

SEQ ID NO: 37098 - protein, 9 aa, Artificial Sequence
  Description of Artificial Sequence: Synthetic peptide
  h3D10 Var 11[PD-L1] vlCDR3
QQWSNNPLT

SEQ ID NO: 37099 - protein, 114 aa, Artificial Sequence; identical to SEQ ID NO: 37011
  Description of Artificial Sequence: Synthetic polypeptide
  h3D10 Var 12[PD-L1] variable heavy Chain

SEQ ID NO: 37100 - protein, 5 aa, Artificial Sequence
  Description of Artificial Sequence: Synthetic peptide
  h3D10 Var 12[PD-L1] vhCDR1
DYYMN

SEQ ID NO: 37101 - protein, 17 aa, Artificial Sequence
  Description of Artificial Sequence: Synthetic peptide
  h3D10 Var 12[PD-L1] vhCDR2
DIDPNYGGTNYAQKFQG

SEQ ID NO: 37102 - protein, 5 aa, Artificial Sequence
  Description of Artificial Sequence: Synthetic peptide
  h3D10 Var 12[PD-L1] vhCDR3
GALTD

SEQ ID NO: 37103 - protein, 106 aa, Artificial Sequence; identical to SEQ ID NO: 37055
  Description of Artificial Sequence: Synthetic polypeptide
  h3D10 Var 12[PD-L1] variable light Chain

SEQ ID NO: 37104 - protein, 10 aa, Artificial Sequence
  Description of Artificial Sequence: Synthetic peptide
  h3D10 Var 12[PD-L1] vlCDR1
RASSGVSYIY

SEQ ID NO: 37105 - protein, 7 aa, Artificial Sequence
  Description of Artificial Sequence: Synthetic peptide
  h3D10 Var 12[PD-L1] vlCDR2
AAFNLAS

SEQ ID NO: 37106 - protein, 9 aa, Artificial Sequence
  Description of Artificial Sequence: Synthetic peptide
  h3D10 Var 12[PD-L1] vlCDR3
QQWSNNPLT

SEQ ID NO: 37107 - protein, 114 aa, Artificial Sequence; identical to SEQ ID NO: 37075
  Description of Artificial Sequence: Synthetic polypeptide
  h3D10 Var 13[PD-L1] variable heavy Chain

SEQ ID NO: 37108 - protein, 5 aa, Artificial Sequence
  Description of Artificial Sequence: Synthetic peptide
  h3D10 Var 13[PD-L1] vhCDR1
DYYMN

SEQ ID NO: 37109 - protein, 17 aa, Artificial Sequence
  Description of Artificial Sequence: Synthetic peptide
  h3D10 Var 13[PD-L1] vhCDR2
DIDPNYGGTTYNQSVKG

SEQ ID NO: 37110 - protein, 5 aa, Artificial Sequence
  Description of Artificial Sequence: Synthetic peptide
  h3D10 Var 13[PD-L1] vhCDR3
GALTD

SEQ ID NO: 37111 - protein, 106 aa, Artificial Sequence; identical to SEQ ID NO: 37031
  Description of Artificial Sequence: Synthetic polypeptide
  h3D10 Var 13[PD-L1] variable light Chain

SEQ ID NO: 37112 - protein, 10 aa, Artificial Sequence
  Description of Artificial Sequence: Synthetic peptide
  h3D10 Var 13[PD-L1] vlCDR1
RASSSVSYIY

SEQ ID NO: 37113 - protein, 7 aa, Artificial Sequence
  Description of Artificial Sequence: Synthetic peptide
  h3D10 Var 13[PD-L1] vlCDR2
ATFNLAS

SEQ ID NO: 37114 - protein, 9 aa, Artificial Sequence
  Description of Artificial Sequence: Synthetic peptide
  h3D10 Var 13[PD-L1] vlCDR3
QQWSNNPLT

SEQ ID NO: 37115 - protein, 114 aa, Artificial Sequence; identical to SEQ ID NO: 37035
  Description of Artificial Sequence: Synthetic polypeptide
  h3D10 Var 14[PD-L1] variable heavy Chain

SEQ ID NO: 37116 - protein, 5 aa, Artificial Sequence
  Description of Artificial Sequence: Synthetic peptide
  h3D10 Var 14[PD-L1] vhCDR1
DYYMN

SEQ ID NO: 37117 - protein, 17 aa, Artificial Sequence
  Description of Artificial Sequence: Synthetic peptide
  h3D10 Var 14[PD-L1] vhCDR2
DIDPNYGGTNYNQKFQG

SEQ ID NO: 37118 - protein, 5 aa, Artificial Sequence
  Description of Artificial Sequence: Synthetic peptide
  h3D10 Var 14[PD-L1] vhCDR3
GALTD

SEQ ID NO: 37119 - protein, 106 aa, Artificial Sequence; identical to SEQ ID NO: 37071
  Description of Artificial Sequence: Synthetic polypeptide
  h3D10 Var 14[PD-L1] variable light Chain

SEQ ID NO: 37120 - protein, 10 aa, Artificial Sequence
  Description of Artificial Sequence: Synthetic peptide
  h3D10 Var 14[PD-L1] vlCDR1
RASSSVSYIY

SEQ ID NO: 37121 - protein, 7 aa, Artificial Sequence
  Description of Artificial Sequence: Synthetic peptide
  h3D10 Var 14[PD-L1] vlCDR2
ATFNLAS

SEQ ID NO: 37122 - protein, 9 aa, Artificial Sequence
  Description of Artificial Sequence: Synthetic peptide
  h3D10 Var 14[PD-L1] vlCDR3
QQWSNNPLT

SEQ ID NO: 37123 - protein, 123 aa, Artificial Sequence
  Description of Artificial Sequence: Synthetic polypeptide
  Antibody A[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSPDYSPYYYYGMDVWGQGTTVTVSS

SEQ ID NO: 37124 - protein, 5 aa, Artificial Sequence
  Description of Artificial Sequence: Synthetic peptide
  Antibody A[PD-L1] vhCDR1
SYAIS

SEQ ID NO: 37125 - protein, 17 aa, Artificial Sequence
  Description of Artificial Sequence: Synthetic peptide
  Antibody A[PD-L1] vhCDR2
GIIPIFGTANYAQKFQG

SEQ ID NO: 37126 - protein, 14 aa, Artificial Sequence
  Description of Artificial Sequence: Synthetic peptide
  Antibody A[PD-L1] vhCDR3
SPDYSPYYYYGMDV

SEQ ID NO: 37127 - protein, 111 aa, Artificial Sequence
  Description of Artificial Sequence: Synthetic polypeptide
  Antibody A[PD-L1] variable light Chain
QSVLTQPPSASGTPGQRVTISCSGSSSNIGSNTVNWYQQLPGTAPKLLIYGNSNRPSGVPDRFSGSKSGTSASLAISGLQSEDEADYYCQSYDSSLSGSVFGGGIKLTVLG

SEQ ID NO: 37128 - protein, 13 aa, Artificial Sequence
  Description of Artificial Sequence: Synthetic peptide
  Antibody A[PD-L1] vlCDR1
SGSSSNIGSNTVN

SEQ ID NO: 37129 - protein, 7 aa, Artificial Sequence
  Description of Artificial Sequence: Synthetic peptide
  Antibody A[PD-L1] vlCDR2
GNSNRPS

SEQ ID NO: 37130 - protein, 11 aa, Artificial Sequence
  Description of Artificial Sequence: Synthetic peptide
  Antibody A[PD-L1] vlCDR3
QSYDSSLSGSV

SEQ ID NO: 37131 - protein, 116 aa, Artificial Sequence
  Description of Artificial Sequence: Synthetic polypeptide
  C5H9v2[PD-L1] variable heavy Chain
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 37132 - protein, 5 aa, Artificial Sequence
  Description of Artificial Sequence: Synthetic peptide
  C5H9v2[PD-L1] vhCDR1
SYAMS

SEQ ID NO: 37133 - protein, 17 aa, Artificial Sequence
  Description of Artificial Sequence: Synthetic peptide
  C5H9v2[PD-L1] vhCDR2
SIWRNGIVTVYADSVKG

SEQ ID NO: 37134 - protein, 7 aa, Artificial Sequence
  Description of Artificial Sequence: Synthetic peptide
  C5H9v2[PD-L1] vhCDR3
WSAAFDY

SEQ ID NO: 37135 - protein, 107 aa, Artificial Sequence
  Description of Artificial Sequence: Synthetic polypeptide
  C5H9v2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIK

SEQ ID NO: 37136 - protein, 11 aa, Artificial Sequence
  Description of Artificial Sequence: Synthetic peptide
  C5H9v2[PD-L1] vlCDR1
RASQSISSYLN

SEQ ID NO: 37137 - protein, 7 aa, Artificial Sequence
  Description of Artificial Sequence: Synthetic peptide
  C5H9v2[PD-L1] vlCDR2
AASSLQS

SEQ ID NO: 37138 - protein, 9 aa, Artificial Sequence
  Description of Artificial Sequence: Synthetic peptide
  C5H9v2[PD-L1] vlCDR3
QQDNGYPST

SEQ ID NO: 37139 - protein, 115 aa, Artificial Sequence
  Description of Artificial Sequence: Synthetic polypeptide
  humanized 29E.2A3[PD-L1] variable heavy Chain
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 37140 - protein, 5 aa, Artificial Sequence
  Description of Artificial Sequence: Synthetic peptide
  humanized 29E.2A3[PD-L1] vhCDR1
SYVMH

SEQ ID NO: 37141 - protein, 17 aa, Artificial Sequence
  Description of Artificial Sequence: Synthetic peptide
  humanized 29E.2A3[PD-L1] vhCDR2
YVNPFNDGTKYNEMFKG

SEQ ID NO: 37142 - protein, 6 aa, Artificial Sequence
  Description of Artificial Sequence: Synthetic peptide
  humanized 29E.2A3[PD-L1] vhCDR3
QAWGYP

SEQ ID NO: 37143 - protein, 111 aa, Artificial Sequence
  Description of Artificial Sequence: Synthetic polypeptide
  humanized 29E.2A3[PD-L1] variable light Chain
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 37144 - protein, 15 aa, Artificial Sequence
  Description of Artificial Sequence: Synthetic peptide
  humanized 29E.2A3[PD-L1] vlCDR1
RATESVEYYGTSLVQ

SEQ ID NO: 37145 - protein, 7 aa, Artificial Sequence
  Description of Artificial Sequence: Synthetic peptide
  humanized 29E.2A3[PD-L1] vlCDR2
AASSVDS

SEQ ID NO: 37146 - protein, 9 aa, Artificial Sequence
  Description of Artificial Sequence: Synthetic peptide
  humanized 29E.2A3[PD-L1] vlCDR3
QQSRRVPYT

SEQ ID NO: 37147 - protein, 121 aa, Artificial Sequence
  Description of Artificial Sequence: Synthetic polypeptide
  1B9[PD-L1] variable heavy Chain
DVQLQESGPGLVKPSQSLSLTCTVTGYSITSDHAWNWIRQVPGNKLEWMGYITYRGSTTYSPSLKSRISITRDTSKNQFFLQLNSVTTEDTATYYCARSMITTGYYVMDYWGQGTSVTVSS

SEQ ID NO: 37148 - protein, 6 aa, Artificial Sequence
  Description of Artificial Sequence: Synthetic peptide
  1B9[PD-L1] vhCDR1
SDHAWN

SEQ ID NO: 37149 - protein, 16 aa, Artificial Sequence
  Description of Artificial Sequence: Synthetic peptide
  1B9[PD-L1] vhCDR2
YITYRGSTTYSPSLKS

SEQ ID NO: 37150 - protein, 12 aa, Artificial Sequence
  Description of Artificial Sequence: Synthetic peptide
  1B9[PD-L1] vhCDR3
SMITTGYYVMDY

SEQ ID NO: 37151 - protein, 107 aa, Artificial Sequence
  Description of Artificial Sequence: Synthetic polypeptide
  1B9[PD-L1] variable light Chain
DIVMTQSHKFMSTSLGDRVTITCKASQDVGISVVWYQQKPGQSPKLLIYWASTRHTGVPDRFTGSGSGTDFTLTINNVQSEDLADYFCQQYSSYPLTVGAGTKLELK

SEQ ID NO: 37152 - protein, 11 aa, Artificial Sequence
  Description of Artificial Sequence: Synthetic peptide
  1B9[PD-L1] vlCDR1
KASQDVGISVV

SEQ ID NO: 37153 - protein, 7 aa, Artificial Sequence
  Description of Artificial Sequence: Synthetic peptide
  1B9[PD-L1] vlCDR2
WASTRHT

SEQ ID NO: 37154 - protein, 9 aa, Artificial Sequence
  Description of Artificial Sequence: Synthetic peptide
  1B9[PD-L1] vlCDR3
QQYSSYPLT

SEQ ID NO: 37155 - protein, 121 aa, Artificial Sequence
  Description of Artificial Sequence: Synthetic polypeptide
  4H1[PD-L1] variable heavy Chain
DVQLQESGPGLVKPSQSLSLTCTVTDYSITSDYAWTWIRQFPGNKLEWMGYITYRGTTRYNPSLTSRISFTRDTSKNQLFLQLNSVTTEDTGTYCCARSMITTGYYAMDYWGQGTSVTVSS

SEQ ID NO: 37156 - protein, 6 aa, Artificial Sequence
  Description of Artificial Sequence: Synthetic peptide
  4H1[PD-L1] vhCDR1
SDYAWT

SEQ ID NO: 37157 - protein, 16 aa, Artificial Sequence
  Description of Artificial Sequence: Synthetic peptide
  4H1[PD-L1] vhCDR2
YITYRGTTRYNPSLTS

SEQ ID NO: 37158 - protein, 12 aa, Artificial Sequence
  Description of Artificial Sequence: Synthetic peptide
  4H1[PD-L1] vhCDR3
SMITTGYYAMDY

SEQ ID NO: 37159 - protein, 107 aa, Artificial Sequence
  Description of Artificial Sequence: Synthetic polypeptide
  4H1[PD-L1] variable light Chain
DIVMTQSHKFMSTSVGDRVSISCKASQDVGISVAWYQQKPGQSPKLLIYWASTRHTGVPVRFTGSGSGTDFTLTISNVQSEDLADYFCQQYSSYPPTFGAGTKLELK

SEQ ID NO: 37160 - protein, 11 aa, Artificial Sequence
  Description of Artificial Sequence: Synthetic peptide
  4H1[PD-L1] vlCDR1
KASQDVGISVA

SEQ ID NO: 37161 - protein, 7 aa, Artificial Sequence
  Description of Artificial Sequence: Synthetic peptide
  4H1[PD-L1] vlCDR2
WASTRHT

SEQ ID NO: 37162 - protein, 9 aa, Artificial Sequence
  Description of Artificial Sequence: Synthetic peptide
  4H1[PD-L1] vlCDR3
QQYSSYPPT

SEQ ID NO: 37163 - protein, 120 aa, Artificial Sequence
  Description of Artificial Sequence: Synthetic polypeptide
  mAb-42[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 37164 - protein, 5 aa, Artificial Sequence
  Description of Artificial Sequence: Synthetic peptide
  mAb-42[PD-L1] vhCDR1
SYAIS

SEQ ID NO: 37165 - protein, 17 aa, Artificial Sequence
  Description of Artificial Sequence: Synthetic peptide
  mAb-42[PD-L1] vhCDR2
GIIPIFGTANYAQKFQG

SEQ ID NO: 37166 - protein, 11 aa, Artificial Sequence
  Description of Artificial Sequence: Synthetic peptide
  mAb-42[PD-L1] vhCDR3
GRQMFGAGIDF

SEQ ID NO: 37167 - protein, 112 aa, Artificial Sequence
  Description of Artificial Sequence: Synthetic polypeptide
  mAb-42[PD-L1] variable light Chain
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 37168 - protein, 13 aa, Artificial Sequence
  Description of Artificial Sequence: Synthetic peptide
  mAb-42[PD-L1] vlCDR1
TRSSGSIDSNYVQ

SEQ ID NO: 37169 - protein, 7 aa, Artificial Sequence
  Description of Artificial Sequence: Synthetic peptide
  mAb-42[PD-L1] vlCDR2
EDNQRPS

SEQ ID NO: 37170 - protein, 11 aa, Artificial Sequence
  Description of Artificial Sequence: Synthetic peptide
  mAb-42[PD-L1] vlCDR3
QSYDSNNRHVI

SEQ ID NO: 37171 - protein, 120 aa, Artificial Sequence
  Description of Artificial Sequence: Synthetic polypeptide
  BAP058-03[PD-L1] variable heavy Chain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 37172 - protein, 5 aa, Artificial Sequence
  Description of Artificial Sequence: Synthetic peptide
  BAP058-03[PD-L1] vhCDR1
SYWMY

SEQ ID NO: 37173 - protein, 17 aa, Artificial Sequence
  Description of Artificial Sequence: Synthetic peptide
  BAP058-03[PD-L1] vhCDR2
RIDPNSGSTKYNEKFKN

SEQ ID NO: 37174 - protein, 11 aa, Artificial Sequence
  Description of Artificial Sequence: Synthetic peptide
  BAP058-03[PD-L1] vhCDR3
DYRKGLYAMDY

SEQ ID NO: 37175 - protein, 107 aa, Artificial Sequence
  Description of Artificial Sequence: Synthetic polypeptide
  BAP058-03[PD-L1] variable light Chain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 37176 - protein, 11 aa, Artificial Sequence
  Description of Artificial Sequence: Synthetic peptide
  BAP058-03[PD-L1] vlCDR1
KASQDVGTAVA

SEQ ID NO: 37177 - protein, 7 aa, Artificial Sequence
  Description of Artificial Sequence: Synthetic peptide
  BAP058-03[PD-L1] vlCDR2
WASTRHT

SEQ ID NO: 37178 - protein, 9 aa, Artificial Sequence
  Description of Artificial Sequence: Synthetic peptide
  BAP058-03[PD-L1] vlCDR3
QQYNSYPLT

SEQ ID NO: 37179 - protein, 120 aa, Artificial Sequence
  Description of Artificial Sequence: Synthetic polypeptide
  BAP058-04[PD-L1] variable heavy Chain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 37180 - protein, 5 aa, Artificial Sequence
  Description of Artificial Sequence: Synthetic peptide
  BAP058-04[PD-L1] vhCDR1
SYWMY

SEQ ID NO: 37181 - protein, 17 aa, Artificial Sequence
  Description of Artificial Sequence: Synthetic peptide
  BAP058-04[PD-L1] vhCDR2
RIDPNSGSTKYNEKFKN

SEQ ID NO: 37182 - protein, 11 aa, Artificial Sequence
  Description of Artificial Sequence: Synthetic peptide
  BAP058-04[PD-L1] vhCDR3
DYRKGLYAMDY

SEQ ID NO: 37183 - protein, 107 aa, Artificial Sequence
  Description of Artificial Sequence: Synthetic polypeptide
  BAP058-04[PD-L1] variable light Chain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 37184 - protein, 11 aa, Artificial Sequence
  Description of Artificial Sequence: Synthetic peptide
  BAP058-04[PD-L1] vlCDR1
KASQDVGTAVA

SEQ ID NO: 37185 - protein, 7 aa, Artificial Sequence
  Description of Artificial Sequence: Synthetic peptide
  BAP058-04[PD-L1] vlCDR2
WASTRHT

SEQ ID NO: 37186 - protein, 9 aa, Artificial Sequence
  Description of Artificial Sequence: Synthetic peptide
  BAP058-04[PD-L1] vlCDR3
QQYNSYPLT

SEQ ID NO: 37187 - protein, 120 aa, Artificial Sequence
  Description of Artificial Sequence: Synthetic polypeptide
  BAP058-06[PD-L1] variable heavy Chain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 37188 - protein, 5 aa, Artificial Sequence
  Description of Artificial Sequence: Synthetic peptide
  BAP058-06[PD-L1] vhCDR1
SYWMY

SEQ ID NO: 37189 - protein, 17 aa, Artificial Sequence
  Description of Artificial Sequence: Synthetic peptide
  BAP058-06[PD-L1] vhCDR2
RIDPNSGSTKYNEKFKN

SEQ ID NO: 37190 - protein, 11 aa, Artificial Sequence
  Description of Artificial Sequence: Synthetic peptide
  BAP058-06[PD-L1] vhCDR3
DYRKGLYAMDY

SEQ ID NO: 37191 - protein, 107 aa, Artificial Sequence; identical to SEQ ID NO: 37183
  Description of Artificial Sequence: Synthetic polypeptide
  BAP058-06[PD-L1] variable light Chain

SEQ ID NO: 37192 - protein, 11 aa, Artificial Sequence
  Description of Artificial Sequence: Synthetic peptide
  BAP058-06[PD-L1] vlCDR1
KASQDVGTAVA

SEQ ID NO: 37193 - protein, 7 aa, Artificial Sequence
  Description of Artificial Sequence: Synthetic peptide
  BAP058-06[PD-L1] vlCDR2
WASTRHT

SEQ ID NO: 37194 - protein, 9 aa, Artificial Sequence
  Description of Artificial Sequence: Synthetic peptide
  BAP058-06[PD-L1] vlCDR3
QQYNSYPLT

SEQ ID NO: 37195 - protein, 120 aa, Artificial Sequence
  Description of Artificial Sequence: Synthetic polypeptide
  BAP058-07[PD-L1] variable heavy Chain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 37196 - protein, 5 aa, Artificial Sequence
  Description of Artificial Sequence: Synthetic peptide
  BAP058-07[PD-L1] vhCDR1
SYWMY

SEQ ID NO: 37197 - protein, 17 aa, Artificial Sequence
  Description of Artificial Sequence: Synthetic peptide
  BAP058-07[PD-L1] vhCDR2
RIDPNSGSTKYNEKFKN

SEQ ID NO: 37198 - protein, 11 aa, Artificial Sequence
  Description of Artificial Sequence: Synthetic peptide
  BAP058-07[PD-L1] vhCDR3
DYRKGLYAMDY

SEQ ID NO: 37199 - protein, 107 aa, Artificial Sequence
  Description of Artificial Sequence: Synthetic polypeptide
  BAP058-07[PD-L1] variable light Chain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 37200 - protein, 11 aa, Artificial Sequence
  Description of Artificial Sequence: Synthetic peptide
  BAP058-07[PD-L1] vlCDR1
KASQDVGTAVA

SEQ ID NO: 37201 - protein, 7 aa, Artificial Sequence
  Description of Artificial Sequence: Synthetic peptide
  BAP058-07[PD-L1] vlCDR2
WASTRHT

SEQ ID NO: 37202 - protein, 9 aa, Artificial Sequence
  Description of Artificial Sequence: Synthetic peptide
  BAP058-07[PD-L1] vlCDR3
QQYNSYPLT

SEQ ID NO: 37203 - protein, 120 aa, Artificial Sequence; identical to SEQ ID NO: 37171
  Description of Artificial Sequence: Synthetic polypeptide
  BAP058-11[PD-L1] variable heavy Chain

SEQ ID NO: 37204 - protein, 5 aa, Artificial Sequence
  Description of Artificial Sequence: Synthetic peptide
  BAP058-11[PD-L1] vhCDR1
SYWMY

SEQ ID NO: 37205 - protein, 17 aa, Artificial Sequence
  Description of Artificial Sequence: Synthetic peptide
  BAP058-11[PD-L1] vhCDR2
RIDPNSGSTKYNEKFKN

SEQ ID NO: 37206 - protein, 11 aa, Artificial Sequence
  Description of Artificial Sequence: Synthetic peptide
  BAP058-11[PD-L1] vhCDR3
DYRKGLYAMDY

SEQ ID NO: 37207 - protein, 107 aa, Artificial Sequence
  Description of Artificial Sequence: Synthetic polypeptide
  BAP058-11[PD-L1] variable light Chain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 37208 - protein, 11 aa, Artificial Sequence
  Description of Artificial Sequence: Synthetic peptide
  BAP058-11[PD-L1] vlCDR1
KASQDVGTAVA

SEQ ID NO: 37209 - protein, 7 aa, Artificial Sequence
  Description of Artificial Sequence: Synthetic peptide
  BAP058-11[PD-L1] vlCDR2
WASTRHT

SEQ ID NO: 37210 - protein, 9 aa, Artificial Sequence
  Description of Artificial Sequence: Synthetic peptide
  BAP058-11[PD-L1] vlCDR3
QQYNSYPLT

SEQ ID NO: 37211 - protein, 120 aa, Artificial Sequence
  Description of Artificial Sequence: Synthetic polypeptide
  BAP058-13[PD-L1] variable heavy Chain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 37212 - protein, 5 aa, Artificial Sequence
  Description of Artificial Sequence: Synthetic peptide
  BAP058-13[PD-L1] vhCDR1
SYWMY

SEQ ID NO: 37213 - protein, 17 aa, Artificial Sequence
  Description of Artificial Sequence: Synthetic peptide
  BAP058-13[PD-L1] vhCDR2
RIDPNSGSTKYNEKFKN

SEQ ID NO: 37214 - protein, 11 aa, Artificial Sequence
  Description of Artificial Sequence: Synthetic peptide
  BAP058-13[PD-L1] vhCDR3
DYRKGLYAMDY

SEQ ID NO: 37215 - protein, 107 aa, Artificial Sequence
  Description of Artificial Sequence: Synthetic polypeptide
  BAP058-13[PD-L1] variable light Chain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 37216 - protein, 11 aa, Artificial Sequence
  Description of Artificial Sequence: Synthetic peptide
  BAP058-13[PD-L1] vlCDR1
KASQDVGTAVA

SEQ ID NO: 37217 - protein, 7 aa, Artificial Sequence
  Description of Artificial Sequence: Synthetic peptide
  BAP058-13[PD-L1] vlCDR2
WASTRHT

SEQ ID NO: 37218 - protein, 9 aa, Artificial Sequence
  Description of Artificial Sequence: Synthetic peptide
  BAP058-13[PD-L1] vlCDR3
QQYNSYPLT

SEQ ID NO: 37219 - protein, 121 aa, Artificial Sequence
  Description of Artificial Sequence: Synthetic polypeptide
  H6[PD-L1] variable heavy Chain
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNIVATITPLDYWGQGTLVTVSS

SEQ ID NO: 37220 - protein, 5 aa, Artificial Sequence
  Description of Artificial Sequence: Synthetic peptide
  H6[PD-L1] vhCDR1
SYAIS

SEQ ID NO: 37221 - protein, 17 aa, Artificial Sequence
  Description of Artificial Sequence: Synthetic peptide
  H6[PD-L1] vhCDR2
GIIPIFGTANYAQKFQG

SEQ ID NO: 37222 - protein, 12 aa, Artificial Sequence
  Description of Artificial Sequence: Synthetic peptide
  H6[PD-L1] vhCDR3
GNIVATITPLDY

SEQ ID NO: 37223 - protein, 108 aa, Artificial Sequence
  Description of Artificial Sequence: Synthetic polypeptide
  H6[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCQVWDSSSDHRIFGGGTKLTVL

SEQ ID NO: 37224 - protein, 11 aa, Artificial Sequence
  Description of Artificial Sequence: Synthetic peptide
  H6[PD-L1] vlCDR1
GGENIGRKTVH

SEQ ID NO: 37225 - protein, 7 aa, Artificial Sequence
  Description of Artificial Sequence: Synthetic peptide
  H6[PD-L1] vlCDR2
YDSDRPS

SEQ ID NO: 37226 - protein, 11 aa, Artificial Sequence
  Description of Artificial Sequence: Synthetic peptide
  H6[PD-L1] vlCDR3
QVWDSSSDHRI

SEQ ID NO: 37227 - protein, 121 aa, Artificial Sequence
  Description of Artificial Sequence: Synthetic polypeptide
  RC5[PD-L1] variable heavy Chain
EVQLLESGGGVVQPGGSLRLSCAASGFTFSSYWMSWVRQAPGKGLEWVANIKQDGSEKYYVDSVKGRFTISRDNSKNTVSLQMNSLRAEDTAVYYCAKDRYYNFPLGMDVWGQGTTVTVSS

SEQ ID NO: 37228 - protein, 5 aa, Artificial Sequence
  Description of Artificial Sequence: Synthetic peptide
  RC5[PD-L1] vhCDR1
SYWMS

SEQ ID NO: 37229 - protein, 17 aa, Artificial Sequence
  Description of Artificial Sequence: Synthetic peptide
  RC5[PD-L1] vhCDR2
NIKQDGSEKYYVDSVKG

SEQ ID NO: 37230 - protein, 12 aa, Artificial Sequence
  Description of Artificial Sequence: Synthetic peptide
  RC5[PD-L1] vhCDR3
DRYYNFPLGMDV

SEQ ID NO: 37231 - protein, 107 aa, Artificial Sequence
  Description of Artificial Sequence: Synthetic polypeptide
  RC5[PD-L1] variable light Chain
AIRMTQSPSSLSASVGDRVTITCRASQSISSYLNWYQQKPGKAPKLLIYTTSSLKSGVPSRFSGSGSGTDFTLTISRLQPEDFATYYCQQSYSSTWTFGRGTKVEIK

SEQ ID NO: 37232 - protein, 11 aa, Artificial Sequence
  Description of Artificial Sequence: Synthetic peptide
  RC5[PD-L1] vlCDR1
RASQSISSYLN

SEQ ID NO: 37233 - protein, 7 aa, Artificial Sequence
  Description of Artificial Sequence: Synthetic peptide
  RC5[PD-L1] vlCDR2
TTSSLKS

SEQ ID NO: 37234 - protein, 9 aa, Artificial Sequence
  Description of Artificial Sequence: Synthetic peptide
  RC5[PD-L1] vlCDR3
QQSYSSTWT

SEQ ID NO: 37235 - protein, 123 aa, Artificial Sequence
  Description of Artificial Sequence: Synthetic polypeptide
  SH1A1Q[PD-L1] variable heavy Chain
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTIYDSSGYSFDYWGQGTLVTVSS

SEQ ID NO: 37236 - protein, 5 aa, Artificial Sequence
  Description of Artificial Sequence: Synthetic peptide
  SH1A1Q[PD-L1] vhCDR1
SYAIS

SEQ ID NO: 37237 - protein, 17 aa, Artificial Sequence
  Description of Artificial Sequence: Synthetic peptide
  SH1A1Q[PD-L1] vhCDR2
GIIPIFGTANYAQKFQG

SEQ ID NO: 37238 - protein, 14 aa, Artificial Sequence
  Description of Artificial Sequence: Synthetic peptide
  SH1A1Q[PD-L1] vhCDR3
EGTIYDSSGYSFDY

SEQ ID NO: 37239 - protein, 110 aa, Artificial Sequence
  Description of Artificial Sequence: Synthetic polypeptide
  SH1A1Q[PD-L1] variable light Chain
QSVLTQPPSVSAAPGQKVTISCSGNNSNIANNYVSWYQQLPGTAPKLLIYDNNYRPSGIPDRFSGSKSGTSATLDITGLQTGDEADYYCGVWDGSLTTGVFGGGTKLTVL

SEQ ID NO: 37240 - protein, 13 aa, Artificial Sequence
  Description of Artificial Sequence: Synthetic peptide
  SH1A1Q[PD-L1] vlCDR1
SGNNSNIANNYVS

SEQ ID NO: 37241 - protein, 7 aa, Artificial Sequence
  Description of Artificial Sequence: Synthetic peptide
  SH1A1Q[PD-L1] vlCDR2
DNNYRPS

SEQ ID NO: 37242 - protein, 11 aa, Artificial Sequence
  Description of Artificial Sequence: Synthetic peptide
  SH1A1Q[PD-L1] vlCDR3
GVWDGSLTTGV

SEQ ID NO: 37243 - protein, 118 aa, Artificial Sequence
  Description of Artificial Sequence: Synthetic polypeptide
  SH1B3[PD-L1] variable heavy Chain
QVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37244 - protein, 5 aa, Artificial Sequence
  Description of Artificial Sequence: Synthetic peptide
  SH1B3[PD-L1] vhCDR1
SYAMH

SEQ ID NO: 37245 - protein, 17 aa, Artificial Sequence
  Description of Artificial Sequence: Synthetic peptide
  SH1B3[PD-L1] vhCDR2
VISFDGSNKYYADSVRG

SEQ ID NO: 37246 - protein, 9 aa, Artificial Sequence
  Description of Artificial Sequence: Synthetic peptide
  SH1B3[PD-L1] vhCDR3
GWLDRDIDY

SEQ ID NO: 37247 - protein, 110 aa, Artificial Sequence
  Description of Artificial Sequence: Synthetic polypeptide
  SH1B3[PD-L1] variable light Chain
LPVLTQPASVSGSPGQSITISCTGTTSDIGGYDYVSWYQQHPGKAPKLMIYDVSKRPSGVSNRFSGSKSGNTASLTISGLQAEDEADYYCSSYTSSSTHVFGTGTKLTVL

SEQ ID NO: 37248 - protein, 14 aa, Artificial Sequence
  Description of Artificial Sequence: Synthetic peptide
  SH1B3[PD-L1] vlCDR1
TGTTSDIGGYDYVS

SEQ ID NO: 37249 - protein, 7 aa, Artificial Sequence
  Description of Artificial Sequence: Synthetic peptide
  SH1B3[PD-L1] vlCDR2
DVSKRPS

SEQ ID NO: 37250 - protein, 10 aa, Artificial Sequence
  Description of Artificial Sequence: Synthetic peptide
  SH1B3[PD-L1] vlCDR3
SSYTSSSTHV

SEQ ID NO: 37251 - protein, 118 aa, Artificial Sequence
  Description of Artificial Sequence: Synthetic polypeptide
  SH1D1[PD-L1] variable heavy Chain
EVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37252 - protein, 5 aa, Artificial Sequence
  Description of Artificial Sequence: Synthetic peptide
  SH1D1[PD-L1] vhCDR1
SYAMH

SEQ ID NO: 37253 - protein, 17 aa, Artificial Sequence
  Description of Artificial Sequence: Synthetic peptide
  SH1D1[PD-L1] vhCDR2
VISFDGSNKYYADSVRG

SEQ ID NO: 37254 - protein, 9 aa, Artificial Sequence
  Description of Artificial Sequence: Synthetic peptide
  SH1D1[PD-L1] vhCDR3
GWLDRDIDY

SEQ ID NO: 37255 - protein, 111 aa, Artificial Sequence
  Description of Artificial Sequence: Synthetic polypeptide
  SH1D1[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYRSSTLGPVFGGGTKLTVL

SEQ ID NO: 37256 - protein, 14 aa, Artificial Sequence
  Description of Artificial Sequence: Synthetic peptide
  SH1D1[PD-L1] vlCDR1
TGTSSDVGGYNYVS

SEQ ID NO: 37257 - protein, 7 aa, Artificial Sequence
  Description of Artificial Sequence: Synthetic peptide
  SH1D1[PD-L1] vlCDR2
DVSNRPS

SEQ ID NO: 37258 - protein, 11 aa, Artificial Sequence
  Description of Artificial Sequence: Synthetic peptide
  SH1D1[PD-L1] vlCDR3
SSYRSSTLGPV

SEQ ID NO: 37259 - protein, 118 aa, Artificial Sequence; identical to SEQ ID NO: 37243
  Description of Artificial Sequence: Synthetic polypeptide
  SH1D2[PD-L1] variable heavy Chain

SEQ ID NO: 37260 - protein, 5 aa, Artificial Sequence
  Description of Artificial Sequence: Synthetic peptide
  SH1D2[PD-L1] vhCDR1
SYAMH

SEQ ID NO: 37261 - protein, 17 aa, Artificial Sequence
  Description of Artificial Sequence: Synthetic peptide
  SH1D2[PD-L1] vhCDR2
VISFDGSNKYYADSVRG

SEQ ID NO: 37262 - protein, 9 aa, Artificial Sequence
  Description of Artificial Sequence: Synthetic peptide
  SH1D2[PD-L1] vhCDR3
GWLDRDIDY

SEQ ID NO: 37263 - protein, 110 aa, Artificial Sequence
  Description of Artificial Sequence: Synthetic polypeptide
  SH1D2[PD-L1] variable light Chain
QAGLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGYVFGTGTKLTVL

SEQ ID NO: 37264 - protein, 13 aa, Artificial Sequence
  Description of Artificial Sequence: Synthetic peptide
  SH1D2[PD-L1] vlCDR1
SGSSSNIGNNAVN

SEQ ID NO: 37265 - protein, 7 aa, Artificial Sequence
  Description of Artificial Sequence: Synthetic peptide
  SH1D2[PD-L1] vlCDR2
YDDLLPS

SEQ ID NO: 37266 - protein, 11 aa, Artificial Sequence
  Description of Artificial Sequence: Synthetic peptide
  SH1D2[PD-L1] vlCDR3
AAWDDSLNGYV

SEQ ID NO: 37267 - protein, 118 aa, Artificial Sequence; identical to SEQ ID NO: 37251
  Description of Artificial Sequence: Synthetic polypeptide
  SH1D12[PD-L1] variable heavy Chain

SEQ ID NO: 37268 - protein, 5 aa, Artificial Sequence
  Description of Artificial Sequence: Synthetic peptide
  SH1D12[PD-L1] vhCDR1
SYAMH

SEQ ID NO: 37269 - protein, 17 aa, Artificial Sequence
  Description of Artificial Sequence: Synthetic peptide
  SH1D12[PD-L1] vhCDR2
VISFDGSNKYYADSVRG

SEQ ID NO: 37270 - protein, 9 aa, Artificial Sequence
  Description of Artificial Sequence: Synthetic peptide
  SH1D12[PD-L1] vhCDR3
GWLDRDIDY

SEQ ID NO: 37271 - protein, 110 aa, Artificial Sequence
  Description of Artificial Sequence: Synthetic polypeptide
  SH1D12[PD-L1] variable light Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSTTHVFGTGTKVTVL

SEQ ID NO: 37272 - protein, 14 aa, Artificial Sequence
  Description of Artificial Sequence: Synthetic peptide
  SH1D12[PD-L1] vlCDR1
TGTSSDVGGYNYVS

SEQ ID NO: 37273 - protein, 7 aa, Artificial Sequence
  Description of Artificial Sequence: Synthetic peptide
  SH1D12[PD-L1] vlCDR2
DVSKRPS

SEQ ID NO: 37274 - protein, 10 aa, Artificial Sequence
  Description of Artificial Sequence: Synthetic peptide
  SH1D12[PD-L1] vlCDR3
SSYTSSTTHV

SEQ ID NO: 37275 - protein, 118 aa, Artificial Sequence; identical to SEQ ID NO: 37251
  Description of Artificial Sequence: Synthetic polypeptide
  SH1E1[PD-L1] variable heavy Chain

SEQ ID NO: 37276 - protein, 5 aa, Artificial Sequence
  Description of Artificial Sequence: Synthetic peptide
  SH1E1[PD-L1] vhCDR1
SYAMH

SEQ ID NO: 37277 - protein, 17 aa, Artificial Sequence
  Description of Artificial Sequence: Synthetic peptide
  SH1E1[PD-L1] vhCDR2
VISFDGSNKYYADSVRG

SEQ ID NO: 37278 - protein, 9 aa, Artificial Sequence
  Description of Artificial Sequence: Synthetic peptide
  SH1E1[PD-L1] vhCDR3
GWLDRDIDY

SEQ ID NO: 37279 - protein, 110 aa, Artificial Sequence
  Description of Artificial Sequence: Synthetic polypeptide
  SH1E1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVWVFGGGTQLTVL

SEQ ID NO: 37280 - protein, 13 aa, Artificial Sequence
  Description of Artificial Sequence: Synthetic peptide
  SH1E1[PD-L1] vlCDR1
SGSSSNIGNNYVS

SEQ ID NO: 37281 - protein, 7 aa, Artificial Sequence
  Description of Artificial Sequence: Synthetic peptide
  SH1E1[PD-L1] vlCDR2
DNNKRPS

SEQ ID NO: 37282 - protein, 11 aa, Artificial Sequence
  Description of Artificial Sequence: Synthetic peptide
  SH1E1[PD-L1] vlCDR3
GTWDSSLSVWV

SEQ ID NO: 37283 - protein, 118 aa, Artificial Sequence; identical to SEQ ID NO: 37243
  Description of Artificial Sequence: Synthetic polypeptide
  SH1G9[PD-L1] variable heavy Chain

SEQ ID NO: 37284 - protein, 5 aa, Artificial Sequence
  Description of Artificial Sequence: Synthetic peptide
  SH1G9[PD-L1] vhCDR1
SYAMH

SEQ ID NO: 37285 - protein, 17 aa, Artificial Sequence
  Description of Artificial Sequence: Synthetic peptide
  SH1G9[PD-L1] vhCDR2
VISFDGSNKYYADSVRG

SEQ ID NO: 37286 - protein, 9 aa, Artificial Sequence
  Description of Artificial Sequence: Synthetic peptide
  SH1G9[PD-L1] vhCDR3
GWLDRDIDY

SEQ ID NO: 37287 - protein, 112 aa, Artificial Sequence
  Description of Artificial Sequence: Synthetic polypeptide
  SH1G9[PD-L1] variable light Chain
QSVLTQPASVSGSPGQSITISCTGTSSDVGGYNYVSWYQQHPGRAPRLMIYDVSNRPSGVSNRFSGSKSGNTASLTISGLQAEDEGDYYCSSYTSGGTLGPVFGGGTKLTVL

SEQ ID NO: 37288 - protein, 14 aa, Artificial Sequence
  Description of Artificial Sequence: Synthetic peptide
  SH1G9[PD-L1] vlCDR1
TGTSSDVGGYNYVS

SEQ ID NO: 37289 - protein, 7 aa, Artificial Sequence
  Description of Artificial Sequence: Synthetic peptide
  SH1G9[PD-L1] vlCDR2
DVSNRPS

SEQ ID NO: 37290 - protein, 12 aa, Artificial Sequence
  Description of Artificial Sequence: Synthetic peptide
  SH1G9[PD-L1] vlCDR3
SSYTSGGTLGPV

SEQ ID NO: 37291 - protein, 120 aa, Artificial Sequence
  Description of Artificial Sequence: Synthetic polypeptide
  SH1E6[PD-L1] variable heavy Chain
QVQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 37292 - protein, 5 aa, Artificial Sequence
  Description of Artificial Sequence: Synthetic peptide
  SH1E6[PD-L1] vhCDR1
RYGVH

SEQ ID NO: 37293 - protein, 17 aa, Artificial Sequence
  Description of Artificial Sequence: Synthetic peptide
  SH1E6[PD-L1] vhCDR2
RLIPIVSMTNYAQKFQD

SEQ ID NO: 37294 - protein, 11 aa, Artificial Sequence
  Description of Artificial Sequence: Synthetic peptide
  SH1E6[PD-L1] vhCDR3
VGQQLPWVFFA

SEQ ID NO: 37295 - protein, 110 aa, Artificial Sequence
  Description of Artificial Sequence: Synthetic polypeptide
  SH1E6[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 37296 - protein, 13 aa, Artificial Sequence
  Description of Artificial Sequence: Synthetic peptide
  SH1E6[PD-L1] vlCDR1
SGSSSNIGNNYVS

SEQ ID NO: 37297 - protein, 7 aa, Artificial Sequence
  Description of Artificial Sequence: Synthetic peptide
  SH1E6[PD-L1] vlCDR2
DNNKRPS

SEQ ID NO: 37298 - protein, 11 aa, Artificial Sequence
  Description of Artificial Sequence: Synthetic peptide
  SH1E6[PD-L1] vlCDR3
GTWDSSLSAVV

SEQ ID NO: 37299 - protein, 118 aa, Artificial Sequence
  Description of Artificial Sequence: Synthetic polypeptide
  SH1A2[PD-L1] variable heavy Chain
QMQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37300 - protein, 5 aa, Artificial Sequence
  Description of Artificial Sequence: Synthetic peptide
  SH1A2[PD-L1] vhCDR1
SYAMH

SEQ ID NO: 37301 - protein, 17 aa, Artificial Sequence
  Description of Artificial Sequence: Synthetic peptide
  SH1A2[PD-L1] vhCDR2
VISFDGSNKYYADSVRG

SEQ ID NO: 37302 - protein, 9 aa, Artificial Sequence
  Description of Artificial Sequence: Synthetic peptide
  SH1A2[PD-L1] vhCDR3
GWLDRDIDY

SEQ ID NO: 37303 - protein, 110 aa, Artificial Sequence
  Description of Artificial Sequence: Synthetic polypeptide
  SH1A2[PD-L1] variable light Chain
QSVVTQPPSVSAAPGQKVTISCSGSSSNIGNNYVSWYQQVPGTAPKLLIYDNNKRPSGIPDRFSGSNSDTSATLGITGLQTGDEADYYCGTWDSSLSAWVFGGGTKLTVL

SEQ ID NO: 37304 - protein, 13 aa, Artificial Sequence
  Description of Artificial Sequence: Synthetic peptide
  SH1A2[PD-L1] vlCDR1
SGSSSNIGNNYVS

SEQ ID NO: 37305 - protein, 7 aa, Artificial Sequence
  Description of Artificial Sequence: Synthetic peptide
  SH1A2[PD-L1] vlCDR2
DNNKRPS

SEQ ID NO: 37306 - protein, 11 aa, Artificial Sequence
  Description of Artificial Sequence: Synthetic peptide
  SH1A2[PD-L1] vlCDR3
GTWDSSLSAWV

SEQ ID NO: 37307 - protein, 118 aa, Artificial Sequence
  Description of Artificial Sequence: Synthetic polypeptide
  SH1B1[PD-L1] variable heavy Chain
QVQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 37308 - protein, 5 aa, Artificial Sequence
  Description of Artificial Sequence: Synthetic peptide
  SH1B1[PD-L1] vhCDR1
SYAMH

SEQ ID NO: 37309 - protein, 17 aa, Artificial Sequence
  Description of Artificial Sequence: Synthetic peptide
  SH1B1[PD-L1] vhCDR2
VISFDGSNKYYADSVRG

SEQ ID NO: 37310 - protein, 9 aa, Artificial Sequence
  Description of Artificial Sequence: Synthetic peptide
  SH1B1[PD-L1] vhCDR3
GWLDRDIDY

SEQ ID NO: 37311 - protein, 112 aa, Artificial Sequence
  Description of Artificial Sequence: Synthetic polypeptide
  SH1B1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSVVFGGGTKLTVL

SEQ ID NO: 37312 - protein, 13 aa, Artificial Sequence
  Description of Artificial Sequence: Synthetic peptide
  SH1B1[PD-L1] vlCDR1
SGSSSNIGNNYVS

SEQ ID NO: 37313 - protein, 7 aa, Artificial Sequence
  Description of Artificial Sequence: Synthetic peptide
  SH1B1[PD-L1] vlCDR2
DNNKRPS

SEQ ID NO: 37314 - protein, 13 aa, Artificial Sequence
  Description of Artificial Sequence: Synthetic peptide
  SH1B1[PD-L1] vlCDR3
GTWDSSLSAGSVV

SEQ ID NO: 37315 - protein, 121 aa, Artificial Sequence
  Description of Artificial Sequence: Synthetic polypeptide
  H6B1L[PD-L1] variable heavy Chain
QMQLVQSGAEVKKPGSSVKVSCKASGGTFSSYAYSWVRQAPGQGLEWMGGIIPSFGTANYAQKFQGRVTITADESTSTAYMELSSLRSEDTAVYYCARGPIVATITPLDYWGQGTLVTVSS

SEQ ID NO: 37316 - protein, 5 aa, Artificial Sequence
  Description of Artificial Sequence: Synthetic peptide
  H6B1L[PD-L1] vhCDR1
SYAYS

SEQ ID NO: 37317 - protein, 17 aa, Artificial Sequence
  Description of Artificial Sequence: Synthetic peptide
  H6B1L[PD-L1] vhCDR2
GIIPSFGTANYAQKFQG

SEQ ID NO: 37318 - protein, 12 aa, Artificial Sequence
  Description of Artificial Sequence: Synthetic peptide
  H6B1L[PD-L1] vhCDR3
GPIVATITPLDY

SEQ ID NO: 37319 - protein, 108 aa, Artificial Sequence
  Description of Artificial Sequence: Synthetic polypeptide
  H6B1L[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCLVWDSSSDHRIFGGGTKLTVL

SEQ ID NO: 37320 - protein, 11 aa, Artificial Sequence
  Description of Artificial Sequence: Synthetic peptide
  H6B1L[PD-L1] vlCDR1
GGENIGRKTVH

SEQ ID NO: 37321 - protein, 7 aa, Artificial Sequence
  Description of Artificial Sequence: Synthetic peptide
  H6B1L[PD-L1] vlCDR2
YDSDRPS

SEQ ID NO: 37322 - protein, 11 aa, Artificial Sequence
  Description of Artificial Sequence: Synthetic peptide
  H6B1L[PD-L1] vlCDR3
LVWDSSSDHRI

SEQ ID NO: 37323 - protein, 121 aa, Artificial Sequence
  Description of Artificial Sequence: Synthetic polypeptide
  H6A1[PD-L1] variable heavy Chain
QMQLVQSGAEVKKPGSSVKVSCKASGGTFSSYAYSWVRQAPGQGLEWMGGIIPIFGTANYAQKFQGRVTITADESTSTAYMELSSLRSEDTAVYYCARGPIVATITPLDYWGQGTLVTVSS

SEQ ID NO: 37324 - protein, 5 aa, Artificial Sequence
  Description of Artificial Sequence: Synthetic peptide
  H6A1[PD-L1] vhCDR1
SYAYS

SEQ ID NO: 37325 - protein, 17 aa, Artificial Sequence
  Description of Artificial Sequence: Synthetic peptide
  H6A1[PD-L1] vhCDR2
GIIPIFGTANYAQKFQG

SEQ ID NO: 37326 - protein, 12 aa, Artificial Sequence
  Description of Artificial Sequence: Synthetic peptide
  H6A1[PD-L1] vhCDR3
GPIVATITPLDY

SEQ ID NO: 37327 - protein, 108 aa, Artificial Sequence; identical to SEQ ID NO: 37223
  Description of Artificial Sequence: Synthetic polypeptide
  H6A1[PD-L1] variable light Chain

SEQ ID NO: 37328 - protein, 11 aa, Artificial Sequence
  Description of Artificial Sequence: Synthetic peptide
  H6A1[PD-L1] vlCDR1
GGENIGRKTVH

SEQ ID NO: 37329 - protein, 7 aa, Artificial Sequence
  Description of Artificial Sequence: Synthetic peptide
  H6A1[PD-L1] vlCDR2
YDSDRPS

SEQ ID NO: 37330 - protein, 11 aa, Artificial Sequence
  Description of Artificial Sequence: Synthetic peptide
  H6A1[PD-L1] vlCDR3
QVWDSSSDHRI

SEQ ID NO: 37331 - protein, 121 aa, Artificial Sequence; identical to SEQ ID NO: 37315
  Description of Artificial Sequence: Synthetic polypeptide
  H6B1[PD-L1] variable heavy Chain

SEQ ID NO: 37332 - protein, 5 aa, Artificial Sequence
  Description of Artificial Sequence: Synthetic peptide
  H6B1[PD-L1] vhCDR1
SYAYS

SEQ ID NO: 37333 - protein, 17 aa, Artificial Sequence
  Description of Artificial Sequence: Synthetic peptide
  H6B1[PD-L1] vhCDR2
GIIPSFGTANYAQKFQG

SEQ ID NO: 37334 - protein, 12 aa, Artificial Sequence
  Description of Artificial Sequence: Synthetic peptide
  H6B1[PD-L1] vhCDR3
GPIVATITPLDY

SEQ ID NO: 37335 - protein, 108 aa, Artificial Sequence; identical to SEQ ID NO: 37223
  Description of Artificial Sequence: Synthetic polypeptide
  H6B1[PD-L1] variable light Chain

SEQ ID NO: 37336 - protein, 11 aa, Artificial Sequence
  Description of Artificial Sequence: Synthetic peptide
  H6B1[PD-L1] vlCDR1
GGENIGRKTVH

SEQ ID NO: 37337 - protein, 7 aa, Artificial Sequence
  Description of Artificial Sequence: Synthetic peptide
  H6B1[PD-L1] vlCDR2
YDSDRPS

SEQ ID NO: 37338 - protein, 11 aa, Artificial Sequence
  Description of Artificial Sequence: Synthetic peptide
  H6B1[PD-L1] vlCDR3
QVWDSSSDHRI

SEQ ID NO: 37339 - protein, 121 aa, Artificial Sequence
  Description of Artificial Sequence: Synthetic polypeptide
  H6B2[PD-L1] variable heavy Chain
QMQLVQSGAEVKKPGSSVKVSCKASGGTFSSYAISWVRQAPGQGLEWMGGIIPAFGTANYAQKFQGRVTITADESTSTAYMELSSLRSEDTAVYYCARGPIVATITPLDYWGQGTLVTVSS

SEQ ID NO: 37340 - protein, 5 aa, Artificial Sequence
  Description of Artificial Sequence: Synthetic peptide
  H6B2[PD-L1] vhCDR1
SYAIS

SEQ ID NO: 37341 - protein, 17 aa, Artificial Sequence
  Description of Artificial Sequence: Synthetic peptide
  H6B2[PD-L1] vhCDR2
GIIPAFGTANYAQKFQG

SEQ ID NO: 37342 - protein, 12 aa, Artificial Sequence
  Description of Artificial Sequence: Synthetic peptide
  H6B2[PD-L1] vhCDR3
GPIVATITPLDY

SEQ ID NO: 37343 - protein, 108 aa, Artificial Sequence; identical to SEQ ID NO: 37223
  Description of Artificial Sequence: Synthetic polypeptide
  H6B2[PD-L1] variable light Chain

SEQ ID NO: 37344 - protein, 11 aa, Artificial Sequence
  Description of Artificial Sequence: Synthetic peptide
  H6B2[PD-L1] vlCDR1
GGENIGRKTVH

SEQ ID NO: 37345 - protein, 7 aa, Artificial Sequence
  Description of Artificial Sequence: Synthetic peptide
  H6B2[PD-L1] vlCDR2
YDSDRPS

SEQ ID NO: 37346 - protein, 11 aa, Artificial Sequence
  Description of Artificial Sequence: Synthetic peptide
  H6B2[PD-L1] vlCDR3
QVWDSSSDHRI

SEQ ID NO: 37347 - protein, 118 aa, Artificial Sequence
  Description of Artificial Sequence: Synthetic polypeptide
  G12[PD-L1] variable heavy Chain
EVQLVQSGAEVKKPGASVKVSCKASGYTFTGYYMHWVRQAPGQGLEWMGWINPNSDNTGSAQKFQGRVFMTKTTSLNTAYMELSGLRSEDTAIYYCARERSSGYFDFWGQGTLVTVSS

SEQ ID NO: 37348 - protein, 5 aa, Artificial Sequence
  Description of Artificial Sequence: Synthetic peptide
  G12[PD-L1] vhCDR1
GYYMH

SEQ ID NO: 37349 - protein, 17 aa, Artificial Sequence
  Description of Artificial Sequence: Synthetic peptide
  G12[PD-L1] vhCDR2
WINPNSDNTGSAQKFQG

SEQ ID NO: 37350 - protein, 9 aa, Artificial Sequence
  Description of Artificial Sequence: Synthetic peptide
  G12[PD-L1] vhCDR3
ERSSGYFDF

SEQ ID NO: 37351 - protein, 107 aa, Artificial Sequence
  Description of Artificial Sequence: Synthetic polypeptide
  G12[PD-L1] variable light Chain
DIVMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 37352 - protein, 11 aa, Artificial Sequence
  Description of Artificial Sequence: Synthetic peptide
  G12[PD-L1] vlCDR1
RASQSISSYLN

SEQ ID NO: 37353 - protein, 7 aa, Artificial Sequence
  Description of Artificial Sequence: Synthetic peptide
  G12[PD-L1] vlCDR2
AASSLQS

SEQ ID NO: 37354 - protein, 9 aa, Artificial Sequence
  Description of Artificial Sequence: Synthetic peptide
  G12[PD-L1] vlCDR3
QQSYSTPIT

SEQ ID NO: 37355 - protein, 118 aa, Artificial Sequence
  Description of Artificial Sequence: Synthetic polypeptide
  RSA1[PD-L1] variable heavy Chain
EVQLVQSGGGLVQPGGSLRLSCAASGFTFSSYSMNWVRQAPGKGLEWVSYISSSSSTIYYADSVKGRFTISRDNAKNSLYLQMNSLRDEDTAVYYCARGDYYYGMDVWGQGTTVTVSS

SEQ ID NO: 37356 - protein, 5 aa, Artificial Sequence
  Description of Artificial Sequence: Synthetic peptide
  RSA1[PD-L1] vhCDR1
SYSMN

SEQ ID NO: 37357 - protein, 17 aa, Artificial Sequence
  Description of Artificial Sequence: Synthetic peptide
  RSA1[PD-L1] vhCDR2
YISSSSSTIYYADSVKG

SEQ ID NO: 37358 - protein, 9 aa, Artificial Sequence
  Description of Artificial Sequence: Synthetic peptide
  RSA1[PD-L1] vhCDR3
GDYYYGMDV

SEQ ID NO: 37359 - protein, 108 aa, Artificial Sequence
  Description of Artificial Sequence: Synthetic polypeptide
  RSA1[PD-L1] variable light Chain
NIQMTQSPSSVSASVGDRVTITCRASQDISRWLAWYQQKPGKAPKLLIYAASSLQSGVPSRFSGSGSGTDFALTISSLQPEDFATYYCQQADSFFSITFGQGTRLEIK

SEQ ID NO: 37360 - protein, 11 aa, Artificial Sequence
  Description of Artificial Sequence: Synthetic peptide
  RSA1[PD-L1] vlCDR1
RASQDISRWLA

SEQ ID NO: 37361 - protein, 7 aa, Artificial Sequence
  Description of Artificial Sequence: Synthetic peptide
  RSA1[PD-L1] vlCDR2
AASSLQS

SEQ ID NO: 37362 - protein, 10 aa, Artificial Sequence
  Description of Artificial Sequence: Synthetic peptide
  RSA1[PD-L1] vlCDR3
QQADSFFSIT

SEQ ID NO: 37363 - protein, 120 aa, Artificial Sequence
  Description of Artificial Sequence: Synthetic polypeptide
  RA3[PD-L1] variable heavy Chain
QMQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 37364 - protein, 5 aa, Artificial Sequence
  Description of Artificial Sequence: Synthetic peptide
  RA3[PD-L1] vhCDR1
RYGVH

SEQ ID NO: 37365 - protein, 17 aa, Artificial Sequence
  Description of Artificial Sequence: Synthetic peptide
  RA3[PD-L1] vhCDR2
RLIPIVSMTNYAQKFQD

SEQ ID NO: 37366 - protein, 11 aa, Artificial Sequence
  Description of Artificial Sequence: Synthetic peptide
  RA3[PD-L1] vhCDR3
VGQQLPWVFFA

SEQ ID NO: 37367 - protein, 107 aa, Artificial Sequence
  Description of Artificial Sequence: Synthetic polypeptide
  RA3[PD-L1] variable light Chain
DIQMTQSPSSLSASVGDRVTITCQASQDISNYLNWYQQKPGKAPKLLIYDASTLQSGVPSRFSGSGSGTDFTLTISSLQPEDFATYYCQQSYSSHWTFGQGTKVEIK

SEQ ID NO: 37368 - protein, 11 aa, Artificial Sequence
  Description of Artificial Sequence: Synthetic peptide
  RA3[PD-L1] vlCDR1
QASQDISNYLN

SEQ ID NO: 37369 - protein, 7 aa, Artificial Sequence
  Description of Artificial Sequence: Synthetic peptide
  RA3[PD-L1] vlCDR2
DASTLQS

SEQ ID NO: 37370 - protein, 9 aa, Artificial Sequence
  Description of Artificial Sequence: Synthetic peptide
  RA3[PD-L1] vlCDR3
QQSYSSHWT

SEQ ID NO: 37371 - protein, 119 aa, Artificial Sequence
  Description of Artificial Sequence: Synthetic polypeptide
  SH1E2[PD-L1] variable heavy Chain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 37372 - protein, 5 aa, Artificial Sequence
  Description of Artificial Sequence: Synthetic peptide
  SH1E2[PD-L1] vhCDR1
SYAIS

SEQ ID NO: 37373 - protein, 17 aa, Artificial Sequence
  Description of Artificial Sequence: Synthetic peptide
  SH1E2[PD-L1] vhCDR2
GIIPIFGTANYAQKFQG

SEQ ID NO: 37374 - protein, 10 aa, Artificial Sequence
  Description of Artificial Sequence: Synthetic peptide
  SH1E2[PD-L1] vhCDR3
APYYYYYMDV

SEQ ID NO: 37375 - protein, 109 aa, Artificial Sequence
  Description of Artificial Sequence: Synthetic polypeptide
  SH1E2[PD-L1] variable light Chain
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 37376 - protein, 14 aa, Artificial Sequence
  Description of Artificial Sequence: Synthetic peptide
  SH1E2[PD-L1] vlCDR1
TGSSSDVGSYNLVS

SEQ ID NO: 37377 - protein, 6 aa, Artificial Sequence
  Description of Artificial Sequence: Synthetic peptide
  SH1E2[PD-L1] vlCDR2
DVSKRS

SEQ ID NO: 37378 - protein, 10 aa, Artificial Sequence
  Description of Artificial Sequence: Synthetic peptide
  SH1E2[PD-L1] vlCDR3
SSYTGISTVV

SEQ ID NO: 37379 - protein, 120 aa, Artificial Sequence; identical to SEQ ID NO: 37291
  Description of Artificial Sequence: Synthetic polypeptide
  SH1E4[PD-L1] variable heavy Chain

SEQ ID NO: 37380 - protein, 5 aa, Artificial Sequence
  Description of Artificial Sequence: Synthetic peptide
  SH1E4[PD-L1] vhCDR1
RYGVH

SEQ ID NO: 37381 - protein, 17 aa, Artificial Sequence
  Description of Artificial Sequence: Synthetic peptide
  SH1E4[PD-L1] vhCDR2
RLIPIVSMTNYAQKFQD

SEQ ID NO: 37382 - protein, 11 aa, Artificial Sequence
  Description of Artificial Sequence: Synthetic peptide
  SH1E4[PD-L1] vhCDR3
VGQQLPWVFFA

SEQ ID NO: 37383 - protein, 112 aa, Artificial Sequence
  Description of Artificial Sequence: Synthetic polypeptide
  SH1E4[PD-L1] variable light Chain
QSVLTQPPSASGSPGQSVTISCTGTSSDIGGYDSVSWYQQHPGKAPKLMIYDVSKRPSGVSNRFSGSKSGNTASLTISGLQAEDEADYYCSSYTSSSIFFYVFGTGTKVTVL

SEQ ID NO: 37384 - protein, 14 aa, Artificial Sequence
  Description of Artificial Sequence: Synthetic peptide
  SH1E4[PD-L1] vlCDR1
TGTSSDIGGYDSVS

SEQ ID NO: 37385 - protein, 7 aa, Artificial Sequence
  Description of Artificial Sequence: Synthetic peptide
  SH1E4[PD-L1] vlCDR2
DVSKRPS

SEQ ID NO: 37386 - protein, 12 aa, Artificial Sequence
  Description of Artificial Sequence: Synthetic peptide
  SH1E4[PD-L1] vlCDR3
SSYTSSSIFFYV

SEQ ID NO: 37387 - protein, 121 aa, Artificial Sequence
  Description of Artificial Sequence: Synthetic polypeptide
  SH1B11[PD-L1] variable heavy Chain
QVQLVQSGSELKKPGSSVKVSCKASGYSFSGYYIHWVRQAPGQGLEWMGWIDPNSGVTNYVRRFQGRVTMTRDTSLSTAYMELSGLTADDTAVYYCARDENLWQFGYLDYWGQGTLVTVSS

SEQ ID NO: 37388 - protein, 5 aa, Artificial Sequence
  Description of Artificial Sequence: Synthetic peptide
  SH1B11[PD-L1] vhCDR1
GYYIH

SEQ ID NO: 37389 - protein, 17 aa, Artificial Sequence
  Description of Artificial Sequence: Synthetic peptide
  SH1B11[PD-L1] vhCDR2
WIDPNSGVTNYVRRFQG

SEQ ID NO: 37390 - protein, 12 aa, Artificial Sequence
  Description of Artificial Sequence: Synthetic peptide
  SH1B11[PD-L1] vhCDR3
DENLWQFGYLDY

SEQ ID NO: 37391 - protein, 107 aa, Artificial Sequence
  Description of Artificial Sequence: Synthetic polypeptide
  SH1B11[PD-L1] variable light Chain
DIVMTQSPSSLSASIGDRVTITCRASQRISAYVNWYQQKPGKAPKVLIYAASSLRSGVPSRFSGSGSGTDFTLTISSLQPEDFATYYCQQTYSSPWTFGQGTKVEIK

SEQ ID NO: 37392 - protein, 11 aa, Artificial Sequence
  Description of Artificial Sequence: Synthetic peptide
  SH1B11[PD-L1] vlCDR1
RASQRISAYVN

SEQ ID NO: 37393 - protein, 7 aa, Artificial Sequence
  Description of Artificial Sequence: Synthetic peptide
  SH1B11[PD-L1] vlCDR2
AASSLRS

SEQ ID NO: 37394 - protein, 9 aa, Artificial Sequence
  Description of Artificial Sequence: Synthetic peptide
  SH1B11[PD-L1] vlCDR3
QQTYSSPWT

SEQ ID NO: 37395 - protein, 119 aa, Artificial Sequence
  Description of Artificial Sequence: Synthetic polypeptide
  SH1C8[PD-L1] variable heavy Chain
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQWLVTELDYWGQGTLVTVSS

SEQ ID NO: 37396 - protein, 5 aa, Artificial Sequence
  Description of Artificial Sequence: Synthetic peptide
  SH1C8[PD-L1] vhCDR1
SYAMH

SEQ ID NO: 37397 - protein, 17 aa, Artificial Sequence
  Description of Artificial Sequence: Synthetic peptide
  SH1C8[PD-L1] vhCDR2
VISYDGSNKYYADSVKG

SEQ ID NO: 37398 - protein, 10 aa, Artificial Sequence
  Description of Artificial Sequence: Synthetic peptide
  SH1C8[PD-L1] vhCDR3
GQWLVTELDY

SEQ ID NO: 37399 - protein, 111 aa, Artificial Sequence
  Description of Artificial Sequence: Synthetic polypeptide
  SH1C8[PD-L1] variable light Chain
QSVVTQPPSVSAAPGQKVTISCSGSSSDIGNHYVSWYQQLPGTAPKLLIYDNNQRPSGIPDRFSGSKSGTSATLAITGLQTGDEADYYCGTWDNSLSPHLLFGGGTKLTVL

SEQ ID NO: 37400 - protein, 13 aa, Artificial Sequence
  Description of Artificial Sequence: Synthetic peptide
  SH1C8[PD-L1] vlCDR1
SGSSSDIGNHYVS

SEQ ID NO: 37401 - protein, 7 aa, Artificial Sequence
  Description of Artificial Sequence: Synthetic peptide
  SH1C8[PD-L1] vlCDR2
DNNQRPS

SEQ ID NO: 37402 - protein, 12 aa, Artificial Sequence
  Description of Artificial Sequence: Synthetic peptide
  SH1C8[PD-L1] vlCDR3
GTWDNSLSPHLL

SEQ ID NO: 37403 - protein, 123 aa, Artificial Sequence
  Description of Artificial Sequence: Synthetic polypeptide
  H1H9364P2[PD-L1] variable heavy Chain
EVQLVESGGGLVQPGRSLRLSCAASGFTFDDYALHWVRQAPGKGLEWVSGISWTGGTIDYADSVKGRFTISRDNAKNSLYLQMSSLRTEDTAIYYCTRDIRGNWKYGGWFDPWGQGTLVTVSS

SEQ ID NO: 37404 - protein, 5 aa, Artificial Sequence
  Description of Artificial Sequence: Synthetic peptide
  H1H9364P2[PD-L1] vhCDR1
DYALH

SEQ ID NO: 37405 - protein, 17 aa, Artificial Sequence
  Description of Artificial Sequence: Synthetic peptide
  H1H9364P2[PD-L1] vhCDR2
GISWTGGTIDYADSVKG

SEQ ID NO: 37406 - protein, 14 aa, Artificial Sequence
  Description of Artificial Sequence: Synthetic peptide
  H1H9364P2[PD-L1] vhCDR3
DIRGNWKYGGWFDP

SEQ ID NO: 37407 - protein, 108 aa, Artificial Sequence; identical to SEQ ID NO: 11711
  Description of Artificial Sequence: Synthetic polypeptide
  H1H9364P2[PD-L1] variable light Chain

SEQ ID NO: 37408 - protein, 11 aa, Artificial Sequence
  Description of Artificial Sequence: Synthetic peptide
  H1H9364P2[PD-L1] vlCDR1
RASQSISSYLN

SEQ ID NO: 37409 - protein, 7 aa, Artificial Sequence
  Description of Artificial Sequence: Synthetic peptide
  H1H9364P2[PD-L1] vlCDR2
AASSLQS

SEQ ID NO: 37410 - protein, 10 aa, Artificial Sequence
  Description of Artificial Sequence: Synthetic peptide
  H1H9364P2[PD-L1] vlCDR3
QQSYSTPPIT

SEQ ID NO: 37411 - protein, 120 aa, Artificial Sequence
  Description of Artificial Sequence: Synthetic polypeptide
  H1H9373P2[PD-L1] variable heavy Chain
QVQLVQSGTEVKKPGASVKVSCKASGYTFTAYYMHWVRQAPGQGLDWMGWISPNSGFTNYAQKFQGRVTMTRDTSINTFYMELSGLRSDDTAVYYCAREGSTHHNSFDPWGQGTLVTVSS

SEQ ID NO: 37412 - protein, 5 aa, Artificial Sequence
  Description of Artificial Sequence: Synthetic peptide
  H1H9373P2[PD-L1] vhCDR1
AYYMH

SEQ ID NO: 37413 - protein, 17 aa, Artificial Sequence
  Description of Artificial Sequence: Synthetic peptide
  H1H9373P2[PD-L1] vhCDR2
WISPNSGFTNYAQKFQG

SEQ ID NO: 37414 - protein, 11 aa, Artificial Sequence
  Description of Artificial Sequence: Synthetic peptide
  H1H9373P2[PD-L1] vhCDR3
EGSTHHNSFDP

SEQ ID NO: 37415 - protein, 108 aa, Artificial Sequence; identical to SEQ ID NO: 11711
  Description of Artificial Sequence: Synthetic polypeptide
  H1H9373P2[PD-L1] variable light Chain

SEQ ID NO: 37416 - protein, 11 aa, Artificial Sequence
  Description of Artificial Sequence: Synthetic peptide
  H1H9373P2[PD-L1] vlCDR1
RASQSISSYLN

SEQ ID NO: 37417 - protein, 7 aa, Artificial Sequence
  Description of Artificial Sequence: Synthetic peptide
  H1H9373P2[PD-L1] vlCDR2
AASSLQS

SEQ ID NO: 37418 - protein, 10 aa, Artificial Sequence
  Description of Artificial Sequence: Synthetic peptide
  H1H9373P2[PD-L1] vlCDR3
QQSYSTPPIT

SEQ ID NO: 37419 - protein, 120 aa, Artificial Sequence
  Description of Artificial Sequence: Synthetic polypeptide
  H1H8314N[PD-L1] variable heavy Chain
EVQLVESGGGVVRPGGSLRLSCAASGFTFDDYGMTWVRQAPGRGLEWVSGIHWHGKRTGYADSVKGRFTISRDNAKKSLYLQMNSLKGEDTALYHCVRGGMSTGDWFDPWGQGTLVIVSS

SEQ ID NO: 37420 - protein, 5 aa, Artificial Sequence
  Description of Artificial Sequence: Synthetic peptide
  H1H8314N[PD-L1] vhCDR1
DYGMT

SEQ ID NO: 37421 - protein, 17 aa, Artificial Sequence
  Description of Artificial Sequence: Synthetic peptide
  H1H8314N[PD-L1] vhCDR2
GIHWHGKRTGYADSVKG

SEQ ID NO: 37422 - protein, 11 aa, Artificial Sequence
  Description of Artificial Sequence: Synthetic peptide
  H1H8314N[PD-L1] vhCDR3
GGMSTGDWFDP

SEQ ID NO: 37423 - protein, 108 aa, Artificial Sequence
  Description of Artificial Sequence: Synthetic polypeptide
  H1H8314N[PD-L1] variable light Chain
DIQMTQSPSSLSASLGDRVTITCRASQSINSYLNWYQQKPGKAPKLLIYVASSLQSGVPSRFSGSGSGTEFTLTISNLQPEDFATYYCQQSYSTPPITFGQGTRLEIK

SEQ ID NO: 37424 - protein, 11 aa, Artificial Sequence
  Description of Artificial Sequence: Synthetic peptide
  H1H8314N[PD-L1] vlCDR1
RASQSINSYLN

SEQ ID NO: 37425 - protein, 7 aa, Artificial Sequence
  Description of Artificial Sequence: Synthetic peptide
  H1H8314N[PD-L1] vlCDR2
VASSLQS

SEQ ID NO: 37426 - protein, 10 aa, Artificial Sequence
  Description of Artificial Sequence: Synthetic peptide
  H1H8314N[PD-L1] vlCDR3
QQSYSTPPIT

SEQ ID NO: 37427 - protein, 119 aa, Artificial Sequence
  Description of Artificial Sequence: Synthetic polypeptide
  PDL1.3.1[PD-L1] variable heavy Chain
EVQLQQSGTELVKPGASVKLSCTTSGFNIQDTYMHWVKQRPEQGLEWIGWIDPANGNTKYDPKFQGKATIIADTSSNTAYLQLRGLTSEDTAVYYCARSGVSTAHFDYWGQGTTLTVSS

SEQ ID NO: 37428 - protein, 5 aa, Artificial Sequence
  Description of Artificial Sequence: Synthetic peptide
  PDL1.3.1[PD-L1] vhCDR1
DTYMH

SEQ ID NO: 37429 - protein, 17 aa, Artificial Sequence
  Description of Artificial Sequence: Synthetic peptide
  PDL1.3.1[PD-L1] vhCDR2
WIDPANGNTKYDPKFQG

SEQ ID NO: 37430 - protein, 10 aa, Artificial Sequence
  Description of Artificial Sequence: Synthetic peptide
  PDL1.3.1[PD-L1] vhCDR3
SGVSTAHFDY

SEQ ID NO: 37431 - protein, 106 aa, Artificial Sequence
  Description of Artificial Sequence: Synthetic polypeptide
  PDL1.3.1[PD-L1] variable light Chain
QIVLSQSPAILSASPGEKVTMTCRASSSVSFMHWYQQKPGSSPKPWIYATSNLASGVPTRFSGSGSGTSYSLTLSRVEAEDAATYYCQQWSSYPRTFGGGTKLEIK

SEQ ID NO: 37432 - protein, 10 aa, Artificial Sequence
  Description of Artificial Sequence: Synthetic peptide
  PDL1.3.1[PD-L1] vlCDR1
RASSSVSFMH

SEQ ID NO: 37433 - protein, 7 aa, Artificial Sequence
  Description of Artificial Sequence: Synthetic peptide
  PDL1.3.1[PD-L1] vlCDR2
ATSNLAS

SEQ ID NO: 37434 - protein, 9 aa, Artificial Sequence
  Description of Artificial Sequence: Synthetic peptide
  PDL1.3.1[PD-L1] vlCDR3
QQWSSYPRT

SEQ ID NO: 37435 - protein, 119 aa, Artificial Sequence; identical to SEQ ID NO: 21505
  Description of Artificial Sequence: Synthetic polypeptide
  10A7[TIGIT] variable heavy Chain

SEQ ID NO: 37436 - protein, 5 aa, Artificial Sequence
  Description of Artificial Sequence: Synthetic peptide
  10A7[TIGIT] vhCDR1
SFTMH

SEQ ID NO: 37437 - protein, 17 aa, Artificial Sequence
  Description of Artificial Sequence: Synthetic peptide
  10A7[TIGIT] vhCDR2
FIRSGSGIVFYADAVRG

SEQ ID NO: 37438 - protein, 10 aa, Artificial Sequence
  Description of Artificial Sequence: Synthetic peptide
  10A7[TIGIT] vhCDR3
RPLGHNTFDS

SEQ ID NO: 37439 - protein, 113 aa, Artificial Sequence; identical to SEQ ID NO: 21510
  Description of Artificial Sequence: Synthetic polypeptide
  10A7[TIGIT] variable light Chain

SEQ ID NO: 37440 - protein, 17 aa, Artificial Sequence
  Description of Artificial Sequence: Synthetic peptide
  10A7[TIGIT] vlCDR1
KSSQSLYYSGVKENLLA

SEQ ID NO: 37441 - protein, 7 aa, Artificial Sequence
  Description of Artificial Sequence: Synthetic peptide
  10A7[TIGIT] vlCDR2
YASIRFT

SEQ ID NO: 37442 - protein, 9 aa, Artificial Sequence
  Description of Artificial Sequence: Synthetic peptide
  10A7[TIGIT] vlCDR3
QQGINNPLT

SEQ ID NO: 37443 - protein, 119 aa, Artificial Sequence; identical to SEQ ID NO: 21515
  Description of Artificial Sequence: Synthetic polypeptide
  1F4[TIGIT] variable heavy Chain

SEQ ID NO: 37444 - protein, 5 aa, Artificial Sequence
  Description of Artificial Sequence: Synthetic peptide
  1F4[TIGIT] vhCDR1
GHLMN

SEQ ID NO: 37445 - protein, 17 aa, Artificial Sequence
  Description of Artificial Sequence: Synthetic peptide
  1F4[TIGIT] vhCDR2
LIIPYNGGTSYNQKFKG

SEQ ID NO: 37446 - protein, 10 aa, Artificial Sequence
  Description of Artificial Sequence: Synthetic peptide
  1F4[TIGIT] vhCDR3
GLRGFYAMDY

SEQ ID NO: 37447 - protein, 112 aa, Artificial Sequence; identical to SEQ ID NO: 21520
  Description of Artificial Sequence: Synthetic polypeptide
  1F4[TIGIT] variable light Chain

SEQ ID NO: 37448 - protein, 16 aa, Artificial Sequence
  Description of Artificial Sequence: Synthetic peptide
  1F4[TIGIT] vlCDR1
RSSQSLVNSYGNTFLS

SEQ ID NO: 37449 - protein, 7 aa, Artificial Sequence
  Description of Artificial Sequence: Synthetic peptide
  1F4[TIGIT] vlCDR2
GISNRFS

SEQ ID NO: 37450 - protein, 9 aa, Artificial Sequence
  Description of Artificial Sequence: Synthetic peptide
  1F4[TIGIT] vlCDR3
LQGTHQPPT

SEQ ID NO: 37451 - protein, 126 aa, Artificial Sequence
  Description of Artificial Sequence: Synthetic polypeptide
  4.1D3[TIGIT] variable heavy Chain
QVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 37452 - protein, 7 aa, Artificial Sequence
  Description of Artificial Sequence: Synthetic peptide
  4.1D3[TIGIT] vhCDR1
SNSAAWN

SEQ ID NO: 37453 - protein, 18 aa, Artificial Sequence
  Description of Artificial Sequence: Synthetic peptide
  4.1D3[TIGIT] vhCDR2
KTYYRFKWYSDYAVSVKG

SEQ ID NO: 37454 - protein, 14 aa, Artificial Sequence
  Description of Artificial Sequence: Synthetic peptide
  4.1D3[TIGIT] vhCDR3
ESTTYDLLAGPFDY

SEQ ID NO: 37455 - protein, 113 aa, Artificial Sequence
  Description of Artificial Sequence: Synthetic polypeptide
  4.1D3[TIGIT] variable light Chain
DIVMTQSPDSLAVSLGERATINCKSSQTVLYSSNNKKYLAWYQQKPGQPPNLLIYWASTRESGVPDRFSGSGSGTDFTLTISSLQAEDVAVYYCQQYYSTPFTFGPGTKVEIK

SEQ ID NO: 37456 - protein, 17 aa, Artificial Sequence
  Description of Artificial Sequence: Synthetic peptide
  4.1D3[TIGIT] vlCDR1
KSSQTVLYSSNNKKYLA

SEQ ID NO: 37457 - protein, 7 aa, Artificial Sequence
  Description of Artificial Sequence: Synthetic peptide
  4.1D3[TIGIT] vlCDR2
WASTRES

SEQ ID NO: 37458 - protein, 9 aa, Artificial Sequence
  Description of Artificial Sequence: Synthetic peptide
  4.1D3[TIGIT] vlCDR3
QQYYSTPFT

SEQ ID NO: 37459 - protein, 126 aa, Artificial Sequence
  Description of Artificial Sequence: Synthetic polypeptide
  4.1D3.Q1E[TIGIT] variable heavy Chain
EVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 37460 - protein, 7 aa, Artificial Sequence
  Description of Artificial Sequence: Synthetic peptide
  4.1D3.Q1E[TIGIT] vhCDR1
SNSAAWN

SEQ ID NO: 37461 - protein, 18 aa, Artificial Sequence
  Description of Artificial Sequence: Synthetic peptide
  4.1D3.Q1E[TIGIT] vhCDR2
KTYYRFKWYSDYAVSVKG

SEQ ID NO: 37462 - protein, 14 aa, Artificial Sequence
  Description of Artificial Sequence: Synthetic peptide
  4.1D3.Q1E[TIGIT] vhCDR3
ESTTYDLLAGPFDY

SEQ ID NO: 37463 - protein, 113 aa, Artificial Sequence; identical to SEQ ID NO: 37455
  Description of Artificial Sequence: Synthetic polypeptide
  4.1D3.Q1E[TIGIT] variable light Chain

SEQ ID NO: 37464 - protein, 17 aa, Artificial Sequence
  Description of Artificial Sequence: Synthetic peptide
  4.1D3.Q1E[TIGIT] vlCDR1
KSSQTVLYSSNNKKYLA

SEQ ID NO: 37465 - protein, 7 aa, Artificial Sequence
  Description of Artificial Sequence: Synthetic peptide
  4.1D3.Q1E[TIGIT] vlCDR2
WASTRES

SEQ ID NO: 37466 - protein, 9 aa, Artificial Sequence
  Description of Artificial Sequence: Synthetic peptide
  4.1D3.Q1E[TIGIT] vlCDR3
QQYYSTPFT

SEQ ID NO: 37467 - protein, 121 aa, Artificial Sequence
  Description of Artificial Sequence: Synthetic polypeptide
  Hu14D7 VH1[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSTVYLQMNSLRAEDTAVYYCRGALYDGFYFDYWGQGTLVTVSS

SEQ ID NO: 37468 - protein, 5 aa, Artificial Sequence
  Description of Artificial Sequence: Synthetic peptide
  Hu14D7 VH1[TIGIT] vhCDR1
GAWMD

SEQ ID NO: 37469 - protein, 19 aa, Artificial Sequence
  Description of Artificial Sequence: Synthetic peptide
  Hu14D7 VH1[TIGIT] vhCDR2
EIRTKVNNHATNYGESVKG

SEQ ID NO: 37470 - protein, 10 aa, Artificial Sequence
  Description of Artificial Sequence: Synthetic peptide
  Hu14D7 VH1[TIGIT] vhCDR3
ALYDGFYFDY

SEQ ID NO: 37471 - protein, 121 aa, Artificial Sequence
  Description of Artificial Sequence: Synthetic polypeptide
  Hu14D7 VH2[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSSVYLQMNSLRAEDTAVYYCRGALYDGFYFDYWGQGTLVTVSS

SEQ ID NO: 37472 - protein, 5 aa, Artificial Sequence
  Description of Artificial Sequence: Synthetic peptide
  Hu14D7 VH2[TIGIT] vhCDR1
GAWMD

SEQ ID NO: 37473 - protein, 19 aa, Artificial Sequence
  Description of Artificial Sequence: Synthetic peptide
  Hu14D7 VH2[TIGIT] vhCDR2
EIRTKVNNHATNYGESVKG

SEQ ID NO: 37474 - protein, 10 aa, Artificial Sequence
  Description of Artificial Sequence: Synthetic peptide
  Hu14D7 VH2[TIGIT] vhCDR3
ALYDGFYFDY

SEQ ID NO: 37475 - protein, 121 aa, Artificial Sequence
  Description of Artificial Sequence: Synthetic polypeptide
  Hu14D7 VH3[TIGIT] variable heavy Chain
EVQLVESGGGLVQPGGSLKLSCAASGFTFSGAWMDWVRQAPGKGLEWVAEIRTKVNNHATNYGESVKGRFTISRDDSKNTVYLQMNSLRAEDTAVYYCRGALYDGFYFDYWGQGTLVTVSS

SEQ ID NO: 37476 - protein, 5 aa, Artificial Sequence
  Description of Artificial Sequence: Synthetic peptide
  Hu14D7 VH3[TIGIT] vhCDR1
GAWMD

SEQ ID NO: 37477 - protein, 19 aa, Artificial Sequence
  Description of Artificial Sequence: Synthetic peptide
  Hu14D7 VH3[TIGIT] vhCDR2
EIRTKVNNHATNYGESVKG

SEQ ID NO: 37478 - protein, 10 aa, Artificial Sequence
  Description of Artificial Sequence: Synthetic peptide
  Hu14D7 VH3[TIGIT] vhCDR3
ALYDGFYFDY

SEQ ID NO: 37479 - protein, 108 aa, Artificial Sequence
  Description of Artificial Sequence: Synthetic polypeptide
  Hu14D7 VL1[TIGIT] variable light Chain
EIVLTQSPATLSLSPGERATLSCSASSSVSSGYLYWYQQKPGQAPKLWIYGTSTLASGVPARFSGSGSGTDYTLTISSLEPEDFAVYYCHQWSSFPYTFGQGTKLEIK

SEQ ID NO: 37480 - protein, 12 aa, Artificial Sequence
  Description of Artificial Sequence: Synthetic peptide
  Hu14D7 VL1[TIGIT] vlCDR1
SASSSVSSGYLY

SEQ ID NO: 37481 - protein, 7 aa, Artificial Sequence
  Description of Artificial Sequence: Synthetic peptide
  Hu14D7 VL1[TIGIT] vlCDR2
GTSTLAS

SEQ ID NO: 37482 - protein, 9 aa, Artificial Sequence
  Description of Artificial Sequence: Synthetic peptide
  Hu14D7 VL1[TIGIT] vlCDR3
HQWSSFPYT

SEQ ID NO: 37483 - protein, 108 aa, Artificial Sequence
  Description of Artificial Sequence: Synthetic polypeptide
  Hu14D7 VL2[TIGIT] variable light Chain
EIVLTQSPATLSLSPGERATLSCSASSSVSSGYLYWYQQKPGQAPRLWIYGTSTLASGVPARFSGSGSGTDYTLTISSLEPEDFAVYYCHQWSSFPYTFGQGTKLEIK

SEQ ID NO: 37484 - protein, 12 aa, Artificial Sequence
  Description of Artificial Sequence: Synthetic peptide
  Hu14D7 VL2[TIGIT] vlCDR1
SASSSVSSGYLY

SEQ ID NO: 37485 - protein, 7 aa, Artificial Sequence
  Description of Artificial Sequence: Synthetic peptide
  Hu14D7 VL2[TIGIT] vlCDR2
GTSTLAS

SEQ ID NO: 37486 - protein, 9 aa, Artificial Sequence
  Description of Artificial Sequence: Synthetic peptide
  Hu14D7 VL2[TIGIT] vlCDR3
HQWSSFPYT

SEQ ID NO: 37487 - protein, 108 aa, Artificial Sequence
  Description of Artificial Sequence: Synthetic polypeptide
  Hu14D7 VL3[TIGIT] variable light Chain
EIVLTQSPATLSLSPGERATLSCSASSSVSSGYLYWYQQKPGQAPRLWIYGTSTLASGIPARFSGSGSGTDYTLTISSLEPEDFAVYYCHQWSSFPYTFGQGTKLEIK

SEQ ID NO: 37488 - protein, 12 aa, Artificial Sequence
  Description of Artificial Sequence: Synthetic peptide
  Hu14D7 VL3[TIGIT] vlCDR1
SASSSVSSGYLY

SEQ ID NO: 37489 - protein, 7 aa, Artificial Sequence
  Description of Artificial Sequence: Synthetic peptide
  Hu14D7 VL3[TIGIT] vlCDR2
GTSTLAS

SEQ ID NO: 37490 - protein, 9 aa, Artificial Sequence
  Description of Artificial Sequence: Synthetic peptide
  Hu14D7 VL3[TIGIT] vlCDR3
HQWSSFPYT

SEQ ID NO: 37491 - protein, 119 aa, Artificial Sequence
  Description of Artificial Sequence: Synthetic polypeptide
  Hu26B10 VH1[TIGIT] variable heavy Chain
EVQLVQSGAEVKKPGASVKISCKTSGYTFTEFTMHWVKQAPGKGLEWIGGLKPDNGGISYNQKFKGRATLTVDKSTNTAYMELSSLRSEDTAVYYCARGAYYRYDADYWGQGTLVTVSS

SEQ ID NO: 37492 - protein, 5 aa, Artificial Sequence
  Description of Artificial Sequence: Synthetic peptide
  Hu26B10 VH1[TIGIT] vhCDR1
EFTMH

SEQ ID NO: 37493 - protein, 17 aa, Artificial Sequence
  Description of Artificial Sequence: Synthetic peptide
  Hu26B10 VH1[TIGIT] vhCDR2
GLKPDNGGISYNQKFKG

SEQ ID NO: 37494 - protein, 10 aa, Artificial Sequence
  Description of Artificial Sequence: Synthetic peptide
  Hu26B10 VH1[TIGIT] vhCDR3
GAYYRYDADY

SEQ ID NO: 37495 - protein, 119 aa, Artificial Sequence
  Description of Artificial Sequence: Synthetic polypeptide
  Hu26B10 VH2[TIGIT] variable heavy Chain
EVQLVQSGAEVKKPGASVKISCKTSGYTFTEFTMHWVRQAPGKGLEWIGGLKPDNGGISYNQKFKGRATLTVDKSTSTAYMELSSLRSEDTAVYYCARGAYYRYDADYWGQGTLVTVSS

SEQ ID NO: 37496 - protein, 5 aa, Artificial Sequence
  Description of Artificial Sequence: Synthetic peptide
  Hu26B10 VH2[TIGIT] vhCDR1
EFTMH

SEQ ID NO: 37497 - protein, 17 aa, Artificial Sequence
  Description of Artificial Sequence: Synthetic peptide
  Hu26B10 VH2[TIGIT] vhCDR2
GLKPDNGGISYNQKFKG

SEQ ID NO: 37498 - protein, 10 aa, Artificial Sequence
  Description of Artificial Sequence: Synthetic peptide
  Hu26B10 VH2[TIGIT] vhCDR3
GAYYRYDADY

SEQ ID NO: 37499 - protein, 119 aa, Artificial Sequence
  Description of Artificial Sequence: Synthetic polypeptide
  Hu26B10 VH3[TIGIT] variable heavy Chain
EVQLVQSGAEVKKPGASVKISCKVSGYTFTEFTMHWVRQAPGKGLEWIGGLKPDNGGISYNQKFKGRATLTVDTSTSTAYMELSSLRSEDTAVYYCARGAYYRYDADYWGQGTLVTVSS

SEQ ID NO: 37500 - protein, 5 aa, Artificial Sequence
  Description of Artificial Sequence: Synthetic peptide
  Hu26B10 VH3[TIGIT] vhCDR1
EFTMH

SEQ ID NO: 37501 - protein, 17 aa, Artificial Sequence
  Description of Artificial Sequence: Synthetic peptide
  Hu26B10 VH3[TIGIT] vhCDR2
GLKPDNGGISYNQKFKG

SEQ ID NO: 37502 - protein, 10 aa, Artificial Sequence
  Description of Artificial Sequence: Synthetic peptide
  Hu26B10 VH3[TIGIT] vhCDR3
GAYYRYDADY

SEQ ID NO: 37503 - protein, 107 aa, Artificial Sequence
  Description of Artificial Sequence: Synthetic polypeptide
  Hu26B10 VL1[TIGIT] variable light Chain
DIQLTQSPSSLSASVGDRVTITCKASQDVKTAVAWYQQKPGKAPKLLIYSASYRNTGVPDRFSGSGSGTDFTFTISSLQPEDFATYYCQQHYSTPFTFGQGTKLEIK

SEQ ID NO: 37504 - protein, 11 aa, Artificial Sequence
  Description of Artificial Sequence: Synthetic peptide
  Hu26B10 VL1[TIGIT] vlCDR1
KASQDVKTAVA

SEQ ID NO: 37505 - protein, 7 aa, Artificial Sequence
  Description of Artificial Sequence: Synthetic peptide
  Hu26B10 VL1[TIGIT] vlCDR2
SASYRNT

SEQ ID NO: 37506 - protein, 9 aa, Artificial Sequence
  Description of Artificial Sequence: Synthetic peptide
  Hu26B10 VL1[TIGIT] vlCDR3
QQHYSTPFT

SEQ ID NO: 37507 - protein, 107 aa, Artificial Sequence
  Description of Artificial Sequence: Synthetic polypeptide
  Hu26B10 VL2[TIGIT] variable light Chain
DIQLTQSPSSLSASVGDRVTITCKASQDVKTAVAWYQQKPGKAPKLLIYSASYRNTGVPSRFSGSGSGTDFTFTISSLQPEDFATYYCQQHYSTPFTFGQGTKLEIK

SEQ ID NO: 37508 - protein, 11 aa, Artificial Sequence
  Description of Artificial Sequence: Synthetic peptide
  Hu26B10 VL2[TIGIT] vlCDR1
KASQDVKTAVA

SEQ ID NO: 37509 - protein, 7 aa, Artificial Sequence
  Description of Artificial Sequence: Synthetic peptide
  Hu26B10 VL2[TIGIT] vlCDR2
SASYRNT

SEQ ID NO: 37510 - protein, 9 aa, Artificial Sequence
  Description of Artificial Sequence: Synthetic peptide
  Hu26B10 VL2[TIGIT] vlCDR3
QQHYSTPFT

SEQ ID NO: 37511 - protein, 107 aa, Artificial Sequence
  Description of Artificial Sequence: Synthetic polypeptide
  Hu26B10 VL3[TIGIT] variable light Chain
DIQLTQSPSSLSASVGDRVTITCKASQDVKTAVAWYQQKPGKAPKLLIYSASYRNTGVPSRFSGSGSGTDFTLTISSLQPEDFATYYCQQHYSTPFTFGQGTKLEIK

SEQ ID NO: 37512 - protein, 11 aa, Artificial Sequence
  Description of Artificial Sequence: Synthetic peptide
  Hu26B10 VL3[TIGIT] vlCDR1
KASQDVKTAVA

SEQ ID NO: 37513 - protein, 7 aa, Artificial Sequence
  Description of Artificial Sequence: Synthetic peptide
  Hu26B10 VL3[TIGIT] vlCDR2
SASYRNT

SEQ ID NO: 37514 - protein, 9 aa, Artificial Sequence
  Description of Artificial Sequence: Synthetic peptide
  Hu26B10 VL3[TIGIT] vlCDR3
QQHYSTPFT

SEQ ID NO: 37515 - protein, 119 aa, Artificial Sequence
  Description of Artificial Sequence: Synthetic polypeptide
  MEB125.31C6.A1.205 VH4/VL1[TIGIT] variable heavy Chain
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 37516 - protein, 5 aa, Artificial Sequence
  Description of Artificial Sequence: Synthetic peptide
  MEB125.31C6.A1.205 VH4/VL1[TIGIT] vhCDR1
SYVMH

SEQ ID NO: 37517 - protein, 17 aa, Artificial Sequence
  Description of Artificial Sequence: Synthetic peptide
  MEB125.31C6.A1.205 VH4/VL1[TIGIT] vhCDR2
YIDPYNDGAKYAQKFQG

SEQ ID NO: 37518 - protein, 10 aa, Artificial Sequence
  Description of Artificial Sequence: Synthetic peptide
  MEB125.31C6.A1.205 VH4/VL1[TIGIT] vhCDR3
GGPYGWYFDV

SEQ ID NO: 37519 - protein, 107 aa, Artificial Sequence
  Description of Artificial Sequence: Synthetic polypeptide
  MEB125.31C6.A1.205 VH4/VL1[TIGIT] variable heavy Chain
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 37520 - protein, 11 aa, Artificial Sequence
  Description of Artificial Sequence: Synthetic peptide
  MEB125.31C6.A1.205 VH4/VL1[TIGIT] vhCDR1
RASEHIYSYLS

SEQ ID NO: 37521 - protein, 7 aa, Artificial Sequence
  Description of Artificial Sequence: Synthetic peptide
  MEB125.31C6.A1.205 VH4/VL1[TIGIT] vhCDR2
NAKTLAE

SEQ ID NO: 37522 - protein, 9 aa, Artificial Sequence
  Description of Artificial Sequence: Synthetic peptide
  MEB125.31C6.A1.205 VH4/VL1[TIGIT] vhCDR3
QHHFGSPLT

SEQ ID NO: 37523 - protein, 119 aa, Artificial Sequence
  Description of Artificial Sequence: Synthetic polypeptide
  MEB125.31C6.A1.205 VH5/VL4[TIGIT] variable heavy Chain
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 37524 - protein, 5 aa, Artificial Sequence
  Description of Artificial Sequence: Synthetic peptide
  MEB125.31C6.A1.205 VH5/VL4[TIGIT] vhCDR1
SYVMH

SEQ ID NO: 37525 - protein, 17 aa, Artificial Sequence
  Description of Artificial Sequence: Synthetic peptide
  MEB125.31C6.A1.205 VH5/VL4[TIGIT] vhCDR2
YIDPYNDGAKYAQKFQG

SEQ ID NO: 37526 - protein, 10 aa, Artificial Sequence
  Description of Artificial Sequence: Synthetic peptide
  MEB125.31C6.A1.205 VH5/VL4[TIGIT] vhCDR3
GGPYGWYFDV

SEQ ID NO: 37527 - protein, 107 aa, Artificial Sequence
  Description of Artificial Sequence: Synthetic polypeptide
  MEB125.31C6.A1.205 VH5/VL4[TIGIT] variable heavy Chain
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 37528 - protein, 11 aa, Artificial Sequence
  Description of Artificial Sequence: Synthetic peptide
  MEB125.31C6.A1.205 VH5/VL4[TIGIT] vhCDR1
RASEHIYSYLS

SEQ ID NO: 37529 - protein, 7 aa, Artificial Sequence
  Description of Artificial Sequence: Synthetic peptide
  MEB125.31C6.A1.205 VH5/VL4[TIGIT] vhCDR2
NAKTLAE

SEQ ID NO: 37530 - protein, 9 aa, Artificial Sequence
  Description of Artificial Sequence: Synthetic peptide
  MEB125.31C6.A1.205 VH5/VL4[TIGIT] vhCDR3
QHHFGSPLT

SEQ ID NO: 37531 - protein, 119 aa, Artificial Sequence; identical to SEQ ID NO: 37523
  Description of Artificial Sequence: Synthetic polypeptide
  MEB125.31C6.A1.205 VH5/VL3[TIGIT] variable heavy Chain

SEQ ID NO: 37532 - protein, 5 aa, Artificial Sequence
  Description of Artificial Sequence: Synthetic peptide
  MEB125.31C6.A1.205 VH5/VL3[TIGIT] vhCDR1
SYVMH

SEQ ID NO: 37533 - protein, 17 aa, Artificial Sequence
  Description of Artificial Sequence: Synthetic peptide
  MEB125.31C6.A1.205 VH5/VL3[TIGIT] vhCDR2
YIDPYNDGAKYAQKFQG

SEQ ID NO: 37534 - protein, 10 aa, Artificial Sequence
  Description of Artificial Sequence: Synthetic peptide
  MEB125.31C6.A1.205 VH5/VL3[TIGIT] vhCDR3
GGPYGWYFDV

SEQ ID NO: 37535 - protein, 107 aa, Artificial Sequence
  Description of Artificial Sequence: Synthetic polypeptide
  MEB125.31C6.A1.205 VH5/VL3[TIGIT] variable heavy Chain
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 37536 - protein, 11 aa, Artificial Sequence
  Description of Artificial Sequence: Synthetic peptide
  MEB125.31C6.A1.205 VH5/VL3[TIGIT] vhCDR1
RASEHIYSYLS

SEQ ID NO: 37537 - protein, 7 aa, Artificial Sequence
  Description of Artificial Sequence: Synthetic peptide
  MEB125.31C6.A1.205 VH5/VL3[TIGIT] vhCDR2
NAKTLAE

SEQ ID NO: 37538 - protein, 9 aa, Artificial Sequence
  Description of Artificial Sequence: Synthetic peptide
  MEB125.31C6.A1.205 VH5/VL3[TIGIT] vhCDR3
QHHFGSPLT

SEQ ID NO: 37539 - protein, 118 aa, Artificial Sequence
  Description of Artificial Sequence: Synthetic polypeptide
  15A6[TIGIT] variable heavy Chain
QLQLQESGPGLVKPSETLSLTCTVSGGSISSSRYFWGWIRQPPGKGLEWIGYIYYRGSTYYNPSLKSRVTIAVDTSKNQFSLKLSSVTAADTAVYYCASSSAWYFDYWGQGNLVTVSS

SEQ ID NO: 37540 - protein, 7 aa, Artificial Sequence
  Description of Artificial Sequence: Synthetic peptide
  15A6[TIGIT] vhCDR1
SSRYFWG

SEQ ID NO: 37541 - protein, 16 aa, Artificial Sequence
  Description of Artificial Sequence: Synthetic peptide
  15A6[TIGIT] vhCDR2
YIYYRGSTYYNPSLKS

SEQ ID NO: 37542 - protein, 8 aa, Artificial Sequence
  Description of Artificial Sequence: Synthetic peptide
  15A6[TIGIT] vhCDR3
SSAWYFDY

SEQ ID NO: 37543 - protein, 107 aa, Artificial Sequence
  Description of Artificial Sequence: Synthetic polypeptide
  15A6[TIGIT] variable light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSLYTFGQGTKLEIK

SEQ ID NO: 37544 - protein, 12 aa, Artificial Sequence
  Description of Artificial Sequence: Synthetic peptide
  15A6[TIGIT] vlCDR1
RASQSVSSSYLA

SEQ ID NO: 37545 - protein, 7 aa, Artificial Sequence
  Description of Artificial Sequence: Synthetic peptide
  15A6[TIGIT] vlCDR2
GASSRAT

SEQ ID NO: 37546 - protein, 8 aa, Artificial Sequence
  Description of Artificial Sequence: Synthetic peptide
  15A6[TIGIT] vlCDR3
QQYGSLYT

SEQ ID NO: 37547 - protein, 130 aa, Artificial Sequence
  Description of Artificial Sequence: Synthetic polypeptide
  22G2[TIGIT] variable heavy Chain
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 37548 - protein, 7 aa, Artificial Sequence
  Description of Artificial Sequence: Synthetic peptide
  22G2[TIGIT] vhCDR1
SGIYYWS

SEQ ID NO: 37549 - protein, 16 aa, Artificial Sequence
  Description of Artificial Sequence: Synthetic peptide
  22G2[TIGIT] vhCDR2
YIYYSGSTNYNPSLKS

SEQ ID NO: 37550 - protein, 20 aa, Artificial Sequence
  Description of Artificial Sequence: Synthetic peptide
  22G2[TIGIT] vhCDR3
DYYVSGNYYNVDYYFFGVDV

SEQ ID NO: 37551 - protein, 109 aa, Artificial Sequence
  Description of Artificial Sequence: Synthetic polypeptide
  22G2[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 37552 - protein, 11 aa, Artificial Sequence
  Description of Artificial Sequence: Synthetic peptide
  22G2[TIGIT] vlCDR1
RASQSVSSYLA

SEQ ID NO: 37553 - protein, 7 aa, Artificial Sequence
  Description of Artificial Sequence: Synthetic peptide
  22G2[TIGIT] vlCDR2
DASNRAT

SEQ ID NO: 37554 - protein, 11 aa, Artificial Sequence
  Description of Artificial Sequence: Synthetic peptide
  22G2[TIGIT] vlCDR3
QQRSNWPPLFT

SEQ ID NO: 37555 - protein, 126 aa, Artificial Sequence
  Description of Artificial Sequence: Synthetic polypeptide
  11G11[TIGIT] variable heavy Chain
QLQLQESGPGLVKPSETLSLTCTVSGGSISSSSHYWGWIRQPPGKGLEWIGNIFYSGHTYYNPSLKSRVTISVDTSKNQFSLKLSSVTAADTAVYYCARQGLLWFGGLSPYYFDYWGQGTLVTVSS

SEQ ID NO: 37556 - protein, 7 aa, Artificial Sequence
  Description of Artificial Sequence: Synthetic peptide
  11G11[TIGIT] vhCDR1
SSSHYWG

SEQ ID NO: 37557 - protein, 16 aa, Artificial Sequence
  Description of Artificial Sequence: Synthetic peptide
  11G11[TIGIT] vhCDR2
NIFYSGHTYYNPSLKS

SEQ ID NO: 37558 - protein, 16 aa, Artificial Sequence
  Description of Artificial Sequence: Synthetic peptide
  11G11[TIGIT] vhCDR3
QGLLWFGGLSPYYFDY

SEQ ID NO: 37559 - protein, 106 aa, Artificial Sequence
  Description of Artificial Sequence: Synthetic polypeptide
  11G11[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKLEIK

SEQ ID NO: 37560 - protein, 11 aa, Artificial Sequence
  Description of Artificial Sequence: Synthetic peptide
  11G11[TIGIT] vlCDR1
RASQSVSSYLA

SEQ ID NO: 37561 - protein, 7 aa, Artificial Sequence
  Description of Artificial Sequence: Synthetic peptide
  11G11[TIGIT] vlCDR2
DASNRAT

SEQ ID NO: 37562 - protein, 8 aa, Artificial Sequence
  Description of Artificial Sequence: Synthetic peptide
  11G11[TIGIT] vlCDR3
QQRSNWPT

SEQ ID NO: 37563 - protein, 128 aa, Artificial Sequence
  Description of Artificial Sequence: Synthetic polypeptide
  10D7[TIGIT] variable heavy Chain
QGQLVQSGAEVKKPGSSVKVSCKASGGIFRNYAISWVRQAPGQGLEWMGGIIPFFGTANYAQKFQGRVTITADESTSTAYMELSSLRSEDTAVYYCARGGAAAGTTRYGYYYYGMDVWGQGTTVTVSS

SEQ ID NO: 37564 - protein, 5 aa, Artificial Sequence
  Description of Artificial Sequence: Synthetic peptide
  10D7[TIGIT] vhCDR1
NYAIS

SEQ ID NO: 37565 - protein, 17 aa, Artificial Sequence
  Description of Artificial Sequence: Synthetic peptide
  10D7[TIGIT] vhCDR2
GIIPFFGTANYAQKFQG

SEQ ID NO: 37566 - protein, 19 aa, Artificial Sequence
  Description of Artificial Sequence: Synthetic peptide
  10D7[TIGIT] vhCDR3
GGAAAGTTRYGYYYYGMDV

SEQ ID NO: 37567 - protein, 107 aa, Artificial Sequence
  Description of Artificial Sequence: Synthetic polypeptide
  10D7[TIGIT] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 37568 - protein, 11 aa, Artificial Sequence
  Description of Artificial Sequence: Synthetic peptide
  10D7[TIGIT] vlCDR1
RASQGISSWLA

SEQ ID NO: 37569 - protein, 7 aa, Artificial Sequence
  Description of Artificial Sequence: Synthetic peptide
  10D7[TIGIT] vlCDR2
AASSLQS

SEQ ID NO: 37570 - protein, 9 aa, Artificial Sequence
  Description of Artificial Sequence: Synthetic peptide
  10D7[TIGIT] vlCDR3
QQYNSYPIT

SEQ ID NO: 37571 - protein, 116 aa, Artificial Sequence
  Description of Artificial Sequence: Synthetic polypeptide
  313R19[TIGIT] variable heavy Chain
QVQLQESGPGLVKPSETLSLTCTVSGFSLSSSYMSWIRQPPGKGLEWIGIIGSNGNTYYANWAKGRVTISKSSNQVSLKLSSVTAADTAVYYCARGGYRTSGMDPWGQGTLVTVSS

SEQ ID NO: 37572 - protein, 5 aa, Artificial Sequence
  Description of Artificial Sequence: Synthetic peptide
  313R19[TIGIT] vhCDR1
SSYMS

SEQ ID NO: 37573 - protein, 14 aa, Artificial Sequence
  Description of Artificial Sequence: Synthetic peptide
  313R19[TIGIT] vhCDR2
IIGSNGNTYYANWA

SEQ ID NO: 37574 - protein, 10 aa, Artificial Sequence
  Description of Artificial Sequence: Synthetic peptide
  313R19[TIGIT] vhCDR3
GGYRTSGMDP

SEQ ID NO: 37575 - protein, 110 aa, Artificial Sequence
  Description of Artificial Sequence: Synthetic polypeptide
  313R19[TIGIT] variable light Chain
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIK

SEQ ID NO: 37576 - protein, 11 aa, Artificial Sequence
  Description of Artificial Sequence: Synthetic peptide
  313R19[TIGIT] vlCDR1
QASQNIYSDLA

SEQ ID NO: 37577 - protein, 7 aa, Artificial Sequence
  Description of Artificial Sequence: Synthetic peptide
  313R19[TIGIT] vlCDR2
RASTLAS

SEQ ID NO: 37578 - protein, 12 aa, Artificial Sequence
  Description of Artificial Sequence: Synthetic peptide
  313R19[TIGIT] vlCDR3
QQEHLVAWIYNV

SEQ ID NO: 37579 - protein, 118 aa, Artificial Sequence
  Description of Artificial Sequence: Synthetic polypeptide
  313M32[TIGIT] variable heavy Chain
QVQLQESGPGLVKPSETLSLTCAVSGYSITSDYAWNWIRQPPGKGLEWIGYISYSGSTSYNPSLRSRVTISRDTSKNQFFLKLSSVTAADTAVYYCARRQVGLGFAYWGQGTLVTVSS

SEQ ID NO: 37580 - protein, 6 aa, Artificial Sequence
  Description of Artificial Sequence: Synthetic peptide
  313M32[TIGIT] vhCDR1
SDYAWN

SEQ ID NO: 37581 - protein, 16 aa, Artificial Sequence
  Description of Artificial Sequence: Synthetic peptide
  313M32[TIGIT] vhCDR2
YISYSGSTSYNPSLRS

SEQ ID NO: 37582 - protein, 9 aa, Artificial Sequence
  Description of Artificial Sequence: Synthetic peptide
  313M32[TIGIT] vhCDR3
RQVGLGFAY

SEQ ID NO: 37583 - protein, 99 aa, Artificial Sequence
  Description of Artificial Sequence: Synthetic polypeptide
  313M32[TIGIT] variable light Chain
DIQMTQSPSSLSASVGDRVTITCKASQDVSTAVAWYQQKPGKAPKLLIYSASYRYTGVPSRFSGSGSGTDFTFTISSLQPEDIATYYCQQHYSTPWTFG

SEQ ID NO: 37584 - protein, 11 aa, Artificial Sequence
  Description of Artificial Sequence: Synthetic peptide
  313M32[TIGIT] vlCDR1
KASQDVSTAVA

SEQ ID NO: 37585 - protein, 7 aa, Artificial Sequence
  Description of Artificial Sequence: Synthetic peptide
  313M32[TIGIT] vlCDR2
SASYRYT

SEQ ID NO: 37586 - protein, 9 aa, Artificial Sequence
  Description of Artificial Sequence: Synthetic peptide
  313M32[TIGIT] vlCDR3
QQHYSTPWT

SEQ ID NO: 37587 - protein, 113 aa, Artificial Sequence
  Description of Artificial Sequence: Synthetic polypeptide
  APE5137[TIM-3] variable heavy Chain
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSS

SEQ ID NO: 37588 - protein, 6 aa, Artificial Sequence
  Description of Artificial Sequence: Synthetic peptide
  APE5137[TIM-3] vhCDR1
SSYDMS

SEQ ID NO: 37589 - protein, 17 aa, Artificial Sequence
  Description of Artificial Sequence: Synthetic peptide
  APE5137[TIM-3] vhCDR2
TISGGGTYTYYQDSVKG

SEQ ID NO: 37590 - protein, 3 aa, Artificial Sequence
  Description of Artificial Sequence: Synthetic peptide
  APE5137[TIM-3] vhCDR3
MDY

SEQ ID NO: 37591 - protein, 107 aa, Artificial Sequence
  Description of Artificial Sequence: Synthetic polypeptide
  APE5137[TIM-3] variable light Chain
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIK

SEQ ID NO: 37592 - protein, 11 aa, Artificial Sequence
  Description of Artificial Sequence: Synthetic peptide
  APE5137[TIM-3] vlCDR1
RASQSIRRYLN

SEQ ID NO: 37593 - protein, 7 aa, Artificial Sequence
  Description of Artificial Sequence: Synthetic peptide
  APE5137[TIM-3] vlCDR2
GASTLQS

SEQ ID NO: 37594 - protein, 9 aa, Artificial Sequence
  Description of Artificial Sequence: Synthetic peptide
  APE5137[TIM-3] vlCDR3
QQSHSAPLT

SEQ ID NO: 37595 - protein, 119 aa, Artificial Sequence
  Description of Artificial Sequence: Synthetic polypeptide
  APE5121[TIM-3] variable heavy Chain
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSS

SEQ ID NO: 37596 - protein, 6 aa, Artificial Sequence
  Description of Artificial Sequence: Synthetic peptide
  APE5121[TIM-3] vhCDR1
GSYAMS

SEQ ID NO: 37597 - protein, 17 aa, Artificial Sequence
  Description of Artificial Sequence: Synthetic peptide
  APE5121[TIM-3] vhCDR2
AISGSGGSTYYADSVKG

SEQ ID NO: 37598 - protein, 9 aa, Artificial Sequence
  Description of Artificial Sequence: Synthetic peptide
  APE5121[TIM-3] vhCDR3
KYYVGPADY

SEQ ID NO: 37599 - protein, 113 aa, Artificial Sequence
  Description of Artificial Sequence: Synthetic polypeptide
  APE5121[TIM-3] variable light Chain
DIVMTQSPDSLAVSLGERATINCKSSQSVLYSSNNKNYLAWYQHKPGQPPKLLIYWASTRESGVPDRFSGSGSGTDFTLTISSLQAEDVAVYYCQQYYSSPLTFGGGTKIEVK

SEQ ID NO: 37600 - protein, 17 aa, Artificial Sequence
  Description of Artificial Sequence: Synthetic peptide
  APE5121[TIM-3] vlCDR1
KSSQSVLYSSNNKNYLA

SEQ ID NO: 37601 - protein, 7 aa, Artificial Sequence
  Description of Artificial Sequence: Synthetic peptide
  APE5121[TIM-3] vlCDR2
WASTRES

SEQ ID NO: 37602 - protein, 9 aa, Artificial Sequence
  Description of Artificial Sequence: Synthetic peptide
  APE5121[TIM-3] vlCDR3
QQYYSSPLT

SEQ ID NO: 37603 - protein, 118 aa, Artificial Sequence
  Description of Artificial Sequence: Synthetic polypeptide
  ABTIM3-hum03[TIM-3] variable heavy Chain
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSS

SEQ ID NO: 37604 - protein, 5 aa, Artificial Sequence
  Description of Artificial Sequence: Synthetic peptide
  ABTIM3-hum03[TIM-3] vhCDR1
SYNMH

SEQ ID NO: 37605 - protein, 17 aa, Artificial Sequence
  Description of Artificial Sequence: Synthetic peptide
  ABTIM3-hum03[TIM-3] vhCDR2
DIYPGQGDTSYNQKFKG

SEQ ID NO: 37606 - protein, 9 aa, Artificial Sequence
  Description of Artificial Sequence: Synthetic peptide
  ABTIM3-hum03[TIM-3] vhCDR3
VGGAFPMDY

SEQ ID NO: 37607 - protein, 111 aa, Artificial Sequence
  Description of Artificial Sequence: Synthetic polypeptide
  ABTIM3-hum03[TIM-3] variable light Chain
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIK

SEQ ID NO: 37608 - protein, 15 aa, Artificial Sequence
  Description of Artificial Sequence: Synthetic peptide
  ABTIM3-hum03[TIM-3] vlCDR1
RASESVEYYGTSLMQ

SEQ ID NO: 37609 - protein, 7 aa, Artificial Sequence
  Description of Artificial Sequence: Synthetic peptide
  ABTIM3-hum03[TIM-3] vlCDR2
AASNVES

SEQ ID NO: 37610 - protein, 9 aa, Artificial Sequence
  Description of Artificial Sequence: Synthetic peptide
  ABTIM3-hum03[TIM-3] vlCDR3
QQSRKDPST

SEQ ID NO: 37611 - protein, 118 aa, Artificial Sequence; identical to SEQ ID NO: 20786
  Description of Artificial Sequence: Synthetic polypeptide
  ABTIM3-hum11[TIM-3] variable heavy Chain

SEQ ID NO: 37612 - protein, 5 aa, Artificial Sequence
  Description of Artificial Sequence: Synthetic peptide
  ABTIM3-hum11[TIM-3] vhCDR1
SYNMH

SEQ ID NO: 37613 - protein, 17 aa, Artificial Sequence
  Description of Artificial Sequence: Synthetic peptide
  ABTIM3-hum11[TIM-3] vhCDR2
DIYPGNGDTSYNQKFKG

SEQ ID NO: 37614 - protein, 9 aa, Artificial Sequence
  Description of Artificial Sequence: Synthetic peptide
  ABTIM3-hum11[TIM-3] vhCDR3
VGGAFPMDY

SEQ ID NO: 37615 - protein, 111 aa, Artificial Sequence; identical to SEQ ID NO: 20791
  Description of Artificial Sequence: Synthetic polypeptide
  ABTIM3-hum11[TIM-3] variable light Chain

SEQ ID NO: 37616 - protein, 15 aa, Artificial Sequence
  Description of Artificial Sequence: Synthetic peptide
  ABTIM3-hum11[TIM-3] vlCDR1
RASESVEYYGTSLMQ

SEQ ID NO: 37617 - protein, 7 aa, Artificial Sequence
  Description of Artificial Sequence: Synthetic peptide
  ABTIM3-hum11[TIM-3] vlCDR2
AASNVES

SEQ ID NO: 37618 - protein, 9 aa, Artificial Sequence
  Description of Artificial Sequence: Synthetic peptide
  ABTIM3-hum11[TIM-3] vlCDR3
QQSRKDPST

SEQ ID NO: 37619 - protein, 118 aa, Artificial Sequence; identical to SEQ ID NO: 37603
  Description of Artificial Sequence: Synthetic polypeptide
  ABTIM3-hum21[TIM-3] variable heavy Chain

SEQ ID NO: 37620 - protein, 5 aa, Artificial Sequence
  Description of Artificial Sequence: Synthetic peptide
  ABTIM3-hum21[TIM-3] vhCDR1
SYNMH

SEQ ID NO: 37621 - protein, 17 aa, Artificial Sequence
  Description of Artificial Sequence: Synthetic peptide
  ABTIM3-hum21[TIM-3] vhCDR2
DIYPGQGDTSYNQKFKG

SEQ ID NO: 37622 - protein, 9 aa, Artificial Sequence
  Description of Artificial Sequence: Synthetic peptide
  ABTIM3-hum21[TIM-3] vhCDR3
VGGAFPMDY

SEQ ID NO: 37623 - protein, 111 aa, Artificial Sequence; identical to SEQ ID NO: 37607
  Description of Artificial Sequence: Synthetic polypeptide
  ABTIM3-hum21[TIM-3] variable light Chain

SEQ ID NO: 37624 - protein, 15 aa, Artificial Sequence
  Description of Artificial Sequence: Synthetic peptide
  ABTIM3-hum21[TIM-3] vlCDR1
RASESVEYYGTSLMQ

SEQ ID NO: 37625 - protein, 7 aa, Artificial Sequence
  Description of Artificial Sequence: Synthetic peptide
  ABTIM3-hum21[TIM-3] vlCDR2
AASNVES

SEQ ID NO: 37626 - protein, 9 aa, Artificial Sequence
  Description of Artificial Sequence: Synthetic peptide
  ABTIM3-hum21[TIM-3] vlCDR3
QQSRKDPST

SEQ ID NO: 37627 - protein, 121 aa, Artificial Sequence
  Description of Artificial Sequence: Synthetic polypeptide
  4177[TIM-3] variable heavy Chain
QVQLQESGPGLVKPSETLSLTCTVSGGSISSYYWSWIRQPPGKGLEWIGYIFHSGSTNYNPSLKSRVTISVDTSKNQFSLKLSSVTAADTAVYYCARDGEYFDMLTGFDYWGQGTLVTVSS

SEQ ID NO: 37628 - protein, 5 aa, Artificial Sequence
  Description of Artificial Sequence: Synthetic peptide
  4177[TIM-3] vhCDR1
SYYWS

SEQ ID NO: 37629 - protein, 16 aa, Artificial Sequence
  Description of Artificial Sequence: Synthetic peptide
  4177[TIM-3] vhCDR2
YIFHSGSTNYNPSLKS

SEQ ID NO: 37630 - protein, 13 aa, Artificial Sequence
  Description of Artificial Sequence: Synthetic peptide
  4177[TIM-3] vhCDR3
DGEYFDMLTGFDY

SEQ ID NO: 37631 - protein, 109 aa, Artificial Sequence
  Description of Artificial Sequence: Synthetic polypeptide
  4177[TIM-3] variable light Chain
RCDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 37632 - protein, 11 aa, Artificial Sequence
  Description of Artificial Sequence: Synthetic peptide
  4177[TIM-3] vlCDR1
RASQGISSWLA

SEQ ID NO: 37633 - protein, 7 aa, Artificial Sequence
  Description of Artificial Sequence: Synthetic peptide
  4177[TIM-3] vlCDR2
AASSLQS

SEQ ID NO: 37634 - protein, 9 aa, Artificial Sequence
  Description of Artificial Sequence: Synthetic peptide
  4177[TIM-3] vlCDR3
QQYNSYPRT

SEQ ID NO: 37635 - protein, 121 aa, Artificial Sequence
  Description of Artificial Sequence: Synthetic polypeptide
  4545[TIM-3] variable heavy Chain
QVQLQESGPGLVKPSETLSLTCTVSGGSFSRGGYYWNWIRQPPGKGLEWIGYIYYSGSTNYNPSLKSRVTISLDTSKNQFSLKLSSVTAADTAVYYCARDHYSSSWTFDYWGQGTLVTVSS

SEQ ID NO: 37636 - protein, 7 aa, Artificial Sequence
  Description of Artificial Sequence: Synthetic peptide
  4545[TIM-3] vhCDR1
RGGYYWN

SEQ ID NO: 37637 - protein, 16 aa, Artificial Sequence
  Description of Artificial Sequence: Synthetic peptide
  4545[TIM-3] vhCDR2
YIYYSGSTNYNPSLKS

SEQ ID NO: 37638 - protein, 11 aa, Artificial Sequence
  Description of Artificial Sequence: Synthetic peptide
  4545[TIM-3] vhCDR3
DHYSSSWTFDY

SEQ ID NO: 37639 - protein, 107 aa, Artificial Sequence
  Description of Artificial Sequence: Synthetic polypeptide
  4545[TIM-3] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKLEIK

SEQ ID NO: 37640 - protein, 11 aa, Artificial Sequence
  Description of Artificial Sequence: Synthetic peptide
  4545[TIM-3] vlCDR1
RASQSVSSYLA

SEQ ID NO: 37641 - protein, 7 aa, Artificial Sequence
  Description of Artificial Sequence: Synthetic peptide
  4545[TIM-3] vlCDR2
DASNRAT

SEQ ID NO: 37642 - protein, 9 aa, Artificial Sequence
  Description of Artificial Sequence: Synthetic peptide
  4545[TIM-3] vlCDR3
QQRSNWPPT

SEQ ID NO: 37643 - protein, 117 aa, Artificial Sequence; identical to SEQ ID NO: 20766
  Description of Artificial Sequence: Synthetic polypeptide
  8213[TIM-3] variable heavy Chain

SEQ ID NO: 37644 - protein, 5 aa, Artificial Sequence
  Description of Artificial Sequence: Synthetic peptide
  8213[TIM-3] vhCDR1
SYWMH

SEQ ID NO: 37645 - protein, 17 aa, Artificial Sequence
  Description of Artificial Sequence: Synthetic peptide
  8213[TIM-3] vhCDR2
EINPSNGRTNYNEKFKT

SEQ ID NO: 37646 - protein, 8 aa, Artificial Sequence
  Description of Artificial Sequence: Synthetic peptide
  8213[TIM-3] vhCDR3
GYYLYFDY

SEQ ID NO: 37647 - protein, 107 aa, Artificial Sequence; identical to SEQ ID NO: 20771
  Description of Artificial Sequence: Synthetic polypeptide
  8213[TIM-3] variable light Chain

SEQ ID NO: 37648 - protein, 11 aa, Artificial Sequence
  Description of Artificial Sequence: Synthetic peptide
  8213[TIM-3] vlCDR1
HASQGIRINIG

SEQ ID NO: 37649 - protein, 7 aa, Artificial Sequence
  Description of Artificial Sequence: Synthetic peptide
  8213[TIM-3] vlCDR2
HGTNLED

SEQ ID NO: 37650 - protein, 9 aa, Artificial Sequence
  Description of Artificial Sequence: Synthetic peptide
  8213[TIM-3] vlCDR3
VQYGQFPWT

SEQ ID NO: 37651 - protein, 117 aa, Artificial Sequence
  Description of Artificial Sequence: Synthetic polypeptide
  mAb15[TIM-3] variable heavy Chain
QVQLKESGPGLVAPSQSLSITCTVSGFSLTGYGVTWVRQPPGKGLEWLGMIWGDGNTDYNSGLKSRLNISKDNSKSQVFLKMNSLQTDDTARYYCARSYYYGPPDYWGQGTTLTVSS

SEQ ID NO: 37652 - protein, 5 aa, Artificial Sequence
  Description of Artificial Sequence: Synthetic peptide
  mAb15[TIM-3] vhCDR1
GYGVT

SEQ ID NO: 37653 - protein, 16 aa, Artificial Sequence
  Description of Artificial Sequence: Synthetic peptide
  mAb15[TIM-3] vhCDR2
MIWGDGNTDYNSGLKS

SEQ ID NO: 37654 - protein, 9 aa, Artificial Sequence
  Description of Artificial Sequence: Synthetic peptide
  mAb15[TIM-3] vhCDR3
SYYYGPPDY

SEQ ID NO: 37655 - protein, 113 aa, Artificial Sequence
  Description of Artificial Sequence: Synthetic polypeptide
  mAb15[TIM-3] variable light Chain
DIVMTQSPSSLAMSVGQKVTMSCKSSQSLLNSRSQKNYLAWYQRKPGQSPKLLLYFASTRESGVPDRFIGSGSGTDFTLTISSVQAEDLADYFCHQHYNTPYTFGGGTKLEIK

SEQ ID NO: 37656 - protein, 17 aa, Artificial Sequence
  Description of Artificial Sequence: Synthetic peptide
  mAb15[TIM-3] vlCDR1
KSSQSLLNSRSQKNYLA

SEQ ID NO: 37657 - protein, 7 aa, Artificial Sequence
  Description of Artificial Sequence: Synthetic peptide
  mAb15[TIM-3] vlCDR2
FASTRES

SEQ ID NO: 37658 - protein, 9 aa, Artificial Sequence
  Description of Artificial Sequence: Synthetic peptide
  mAb15[TIM-3] vlCDR3
HQHYNTPYT

SEQ ID NO: 37659 - protein, 121 aa, Artificial Sequence
  Description of Artificial Sequence: Synthetic polypeptide
  mAb58[TIM-3] variable heavy Chain
QIQLVQSGPELKKPGETVKISCKASGYTFTTYGMSWVKQAPGKGLKLMGWINTYSGAPTYADDFKGRFAFSLETSASAAYLQINNLKNEDTATYFCARKPPHYYVNSFDYWGQGTTLTVSS

SEQ ID NO: 37660 - protein, 5 aa, Artificial Sequence
  Description of Artificial Sequence: Synthetic peptide
  mAb58[TIM-3] vhCDR1
TYGMS

SEQ ID NO: 37661 - protein, 17 aa, Artificial Sequence
  Description of Artificial Sequence: Synthetic peptide
  mAb58[TIM-3] vhCDR2
WINTYSGAPTYADDFKG

SEQ ID NO: 37662 - protein, 12 aa, Artificial Sequence
  Description of Artificial Sequence: Synthetic peptide
  mAb58[TIM-3] vhCDR3
KPPHYYVNSFDY

SEQ ID NO: 37663 - protein, 107 aa, Artificial Sequence
  Description of Artificial Sequence: Synthetic polypeptide
  mAb58[TIM-3] variable light Chain
DIVMTQSPATLSVTPGDRVSLSCRASQSISDYLHWYQQKSHESPRLLIKYASQSISGIPSRFSGSGSGSDFTLSINSVEPEDVGVYYCQNGHSFPYTFGGGTKLEIK

SEQ ID NO: 37664 - protein, 11 aa, Artificial Sequence
  Description of Artificial Sequence: Synthetic peptide
  mAb58[TIM-3] vlCDR1
RASQSISDYLH

SEQ ID NO: 37665 - protein, 7 aa, Artificial Sequence
  Description of Artificial Sequence: Synthetic peptide
  mAb58[TIM-3] vlCDR2
YASQSIS

SEQ ID NO: 37666 - protein, 9 aa, Artificial Sequence
  Description of Artificial Sequence: Synthetic peptide
  mAb58[TIM-3] vlCDR3
QNGHSFPYT

SEQ ID NO: 37667 - protein, 120 aa, Artificial Sequence
  Description of Artificial Sequence: Synthetic polypeptide
  TIM3-0433[TIM-3] variable heavy Chain
QITLKESGPTLVKPTQTLTLTCTFSGFSLSTSGMSVGWIRQPPGKGLEWLAHIWLNDDVFFNPALKSRLTITKDTSKNQVVLTMTNMDPVDTATYYCVRANGYLYALDYWGQGTLVTVSS

SEQ ID NO: 37668 - protein, 7 aa, Artificial Sequence
  Description of Artificial Sequence: Synthetic peptide
  TIM3-0433[TIM-3] vhCDR1
TSGMSVG

SEQ ID NO: 37669 - protein, 16 aa, Artificial Sequence
  Description of Artificial Sequence: Synthetic peptide
  TIM3-0433[TIM-3] vhCDR2
HIWLNDDVFFNPALKS

SEQ ID NO: 37670 - protein, 10 aa, Artificial Sequence
  Description of Artificial Sequence: Synthetic peptide
  TIM3-0433[TIM-3] vhCDR3
ANGYLYALDY

SEQ ID NO: 37671 - protein, 106 aa, Artificial Sequence
  Description of Artificial Sequence: Synthetic polypeptide
  TIM3-0433[TIM-3] variable light Chain
ETTLTQSPAFMSATPGDKVNIACSASSSVSYTQWYQQKPGEAPKLWIYDAFKLAPGIPPRFSGSGYGTDFTLTINNIESEDAAYYFCHQWSSYPWTFGQGTKLEIK

SEQ ID NO: 37672 - protein, 10 aa, Artificial Sequence
  Description of Artificial Sequence: Synthetic peptide
  TIM3-0433[TIM-3] vlCDR1
SASSSVSYTQ

SEQ ID NO: 37673 - protein, 7 aa, Artificial Sequence
  Description of Artificial Sequence: Synthetic peptide
  TIM3-0433[TIM-3] vlCDR2
DAFKLAP

SEQ ID NO: 37674 - protein, 9 aa, Artificial Sequence
  Description of Artificial Sequence: Synthetic peptide
  TIM3-0433[TIM-3] vlCDR3
HQWSSYPWT

SEQ ID NO: 37675 - protein, 120 aa, Artificial Sequence; identical to SEQ ID NO: 37667
  Description of Artificial Sequence: Synthetic polypeptide
  TIM3-0434[TIM-3] variable heavy Chain

SEQ ID NO: 37676 - protein, 7 aa, Artificial Sequence
  Description of Artificial Sequence: Synthetic peptide
  TIM3-0434[TIM-3] vhCDR1
TSGMSVG

SEQ ID NO: 37677 - protein, 16 aa, Artificial Sequence
  Description of Artificial Sequence: Synthetic peptide
  TIM3-0434[TIM-3] vhCDR2
HIWLNDDVFFNPALKS

SEQ ID NO: 37678 - protein, 10 aa, Artificial Sequence
  Description of Artificial Sequence: Synthetic peptide
  TIM3-0434[TIM-3] vhCDR3
ANGYLYALDY

SEQ ID NO: 37679 - protein, 106 aa, Artificial Sequence
  Description of Artificial Sequence: Synthetic polypeptide
  TIM3-0434[TIM-3] variable light Chain
DIQLTQSPSFLSASVGDRVTITCSASSSVSYTQWYQQKPGKAPKLWIYDAFKLAPGVPSRFSGSGSGTEFTLTISSLQPEDFATYFCHQWSSYPWTFGQGTKLEIK

SEQ ID NO: 37680 - protein, 10 aa, Artificial Sequence
  Description of Artificial Sequence: Synthetic peptide
  TIM3-0434[TIM-3] vlCDR1
SASSSVSYTQ

SEQ ID NO: 37681 - protein, 7 aa, Artificial Sequence
  Description of Artificial Sequence: Synthetic peptide
  TIM3-0434[TIM-3] vlCDR2
DAFKLAP

SEQ ID NO: 37682 - protein, 9 aa, Artificial Sequence
  Description of Artificial Sequence: Synthetic peptide
  TIM3-0434[TIM-3] vlCDR3
HQWSSYPWT

SEQ ID NO: 37683 - protein, 119 aa, Artificial Sequence
  Description of Artificial Sequence: Synthetic polypeptide
  TIM3-0438[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTVSS

SEQ ID NO: 37684 - protein, 5 aa, Artificial Sequence
  Description of Artificial Sequence: Synthetic peptide
  TIM3-0438[TIM-3] vhCDR1
TTYMH

SEQ ID NO: 37685 - protein, 17 aa, Artificial Sequence
  Description of Artificial Sequence: Synthetic peptide
  TIM3-0438[TIM-3] vhCDR2
RIDPADDNTKYAPKFQG

SEQ ID NO: 37686 - protein, 10 aa, Artificial Sequence
  Description of Artificial Sequence: Synthetic peptide
  TIM3-0438[TIM-3] vhCDR3
DFGYVAWFAY

SEQ ID NO: 37687 - protein, 107 aa, Artificial Sequence
  Description of Artificial Sequence: Synthetic polypeptide
  TIM3-0438[TIM-3] variable light Chain
DIVMTQSPLSLPVTPGEPASISCRASQSVDNYVAWYLQKPGQSPQLLIYYASNRYIGVPDRFSGSGSGTDFTLKISRVEAEDVGVYYCQQHYSSPYTFGQGTKVEIK

SEQ ID NO: 37688 - protein, 11 aa, Artificial Sequence
  Description of Artificial Sequence: Synthetic peptide
  TIM3-0438[TIM-3] vlCDR1
RASQSVDNYVA

SEQ ID NO: 37689 - protein, 7 aa, Artificial Sequence
  Description of Artificial Sequence: Synthetic peptide
  TIM3-0438[TIM-3] vlCDR2
YASNRYI

SEQ ID NO: 37690 - protein, 9 aa, Artificial Sequence
  Description of Artificial Sequence: Synthetic peptide
  TIM3-0438[TIM-3] vlCDR3
QQHYSSPYT

SEQ ID NO: 37691 - protein, 119 aa, Artificial Sequence
  Description of Artificial Sequence: Synthetic polypeptide
  TIM3-0443[TIM-3] variable heavy Chain
EVQLVESGGGLVQPGGSLRLSCAASGFNIKTTYMHWVRQAPGKGLEWVGRIDPADDNTKYAPKFQGKATISADTSKNTAYLQMNSLRAEDTAVYYCVRDFGYVAWFAYWGQGTLVTFSS

SEQ ID NO: 37692 - protein, 5 aa, Artificial Sequence
  Description of Artificial Sequence: Synthetic peptide
  TIM3-0443[TIM-3] vhCDR1
TTYMH

SEQ ID NO: 37693 - protein, 17 aa, Artificial Sequence
  Description of Artificial Sequence: Synthetic peptide
  TIM3-0443[TIM-3] vhCDR2
RIDPADDNTKYAPKFQG

SEQ ID NO: 37694 - protein, 10 aa, Artificial Sequence
  Description of Artificial Sequence: Synthetic peptide
  TIM3-0443[TIM-3] vhCDR3
DFGYVAWFAY

SEQ ID NO: 37695 - protein, 107 aa, Artificial Sequence; identical to SEQ ID NO: 37687
  Description of Artificial Sequence: Synthetic polypeptide
  TIM3-0443[TIM-3] variable light Chain

SEQ ID NO: 37696 - protein, 11 aa, Artificial Sequence
  Description of Artificial Sequence: Synthetic peptide
  TIM3-0443[TIM-3] vlCDR1
RASQSVDNYVA

SEQ ID NO: 37697 - protein, 7 aa, Artificial Sequence
  Description of Artificial Sequence: Synthetic peptide
  TIM3-0443[TIM-3] vlCDR2
YASNRYI

SEQ ID NO: 37698 - protein, 9 aa, Artificial Sequence
  Description of Artificial Sequence: Synthetic peptide
  TIM3-0443[TIM-3] vlCDR3
QQHYSSPYT

SEQ ID NO: 37699 - protein, 15 aa, Artificial Sequence
  Description of Artificial Sequence: Synthetic peptide
GGGGSGGGGSGGGGS

SEQ ID NO: 37700 - protein, 18 aa, Artificial Sequence
  Description of Artificial Sequence: Synthetic peptide
GSTSGSGKPGSGEGSTKG

SEQ ID NO: 37701 - protein, 14 aa, Artificial Sequence
  Description of Artificial Sequence: Synthetic peptide
IRPRAIGGSKPRVA

SEQ ID NO: 37702 - protein, 15 aa, Artificial Sequence
  Description of Artificial Sequence: Synthetic peptide
GKGGSGKGGSGKGGS

SEQ ID NO: 37703 - protein, 15 aa, Artificial Sequence
  Description of Artificial Sequence: Synthetic peptide
GGKGSGGKGSGGKGS

SEQ ID NO: 37704 - protein, 15 aa, Artificial Sequence
  Description of Artificial Sequence: Synthetic peptide
GGGKSGGGKSGGGKS

SEQ ID NO: 37705 - protein, 15 aa, Artificial Sequence
  Description of Artificial Sequence: Synthetic peptide
GKGKSGKGKSGKGKS

SEQ ID NO: 37706 - protein, 15 aa, Artificial Sequence
  Description of Artificial Sequence: Synthetic peptide
GGGKSGGKGSGKGGS

SEQ ID NO: 37707 - protein, 15 aa, Artificial Sequence
  Description of Artificial Sequence: Synthetic peptide
GKPGSGKPGSGKPGS

SEQ ID NO: 37708 - protein, 20 aa, Artificial Sequence
  Description of Artificial Sequence: Synthetic peptide
GKPGSGKPGSGKPGSGKPGS

SEQ ID NO: 37709 - protein, 20 aa, Artificial Sequence
  Description of Artificial Sequence: Synthetic peptide
GKGKSGKGKSGKGKSGKGKS

SEQ ID NO: 37710 - protein, 20 aa, Artificial Sequence
  Description of Artificial Sequence: Synthetic peptide
GGGGSGGGGSGGGGSGGGGS

SEQ ID NO: 37711 - protein, 14 aa, Artificial Sequence
  Description of Artificial Sequence: Synthetic peptide
STAGDTHLGGEDFD

SEQ ID NO: 37712 - protein, 15 aa, Artificial Sequence
  Description of Artificial Sequence: Synthetic peptide
GEGGSGEGGSGEGGS

SEQ ID NO: 37713 - protein, 15 aa, Artificial Sequence
  Description of Artificial Sequence: Synthetic peptide
GGEGSGGEGSGGEGS

SEQ ID NO: 37714 - protein, 15 aa, Artificial Sequence
  Description of Artificial Sequence: Synthetic peptide
GGGESGGGESGGGES

SEQ ID NO: 37715 - protein, 15 aa, Artificial Sequence
  Description of Artificial Sequence: Synthetic peptide
GEGESGEGESGEGES

SEQ ID NO: 37716 - protein, 15 aa, Artificial Sequence
  Description of Artificial Sequence: Synthetic peptide
GGGESGGEGSGEGGS

SEQ ID NO: 37717 - protein, 20 aa, Artificial Sequence
  Description of Artificial Sequence: Synthetic peptide
GEGESGEGESGEGESGEGES

SEQ ID NO: 37718 - protein, 15 aa, Artificial Sequence
  Description of Artificial Sequence: Synthetic peptide
GGGGSGGGGSGGGGS

SEQ ID NO: 37719 - protein, 20 aa, Artificial Sequence
  Description of Artificial Sequence: Synthetic peptide
GGGGSGGGGSGGGGSGGGGS

SEQ ID NO: 37720 - protein, 18 aa, Artificial Sequence
  Description of Artificial Sequence: Synthetic peptide
GSTSGSGKPGSGEGSTKG

SEQ ID NO: 37721 - protein, 19 aa, Artificial Sequence
  Description of Artificial Sequence: Synthetic peptide
PRGASKSGSASQTGSAPGS

SEQ ID NO: 37722 - protein, 19 aa, Artificial Sequence
  Description of Artificial Sequence: Synthetic peptide
GTAAAGAGAAGGAAAGAAG

SEQ ID NO: 37723 - protein, 19 aa, Artificial Sequence
  Description of Artificial Sequence: Synthetic peptide
GTSGSSGSGSGGSGSGGGG

SEQ ID NO: 37724 - protein, 20 aa, Artificial Sequence
  Description of Artificial Sequence: Synthetic peptide
GKPGSGKPGSGKPGSGKPGS

SEQ ID NO: 37725 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 37726 - protein, 231 aa, Artificial Sequence; identical to SEQ ID NO: 21532
  Description of Artificial Sequence: Synthetic polypeptide

SEQ ID NO: 37727 - protein, 107 aa, Artificial Sequence [sequence omitted]

SEQ ID NO: 37728 - protein, 329 aa, Artificial Sequence; identical to SEQ ID NO: 37725
  Description of Artificial Sequence: Synthetic polypeptide

SEQ ID NO: 37729 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37730 - protein, 107 aa, Artificial Sequence [sequence omitted]

SEQ ID NO: 37731 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 37732 - protein, 231 aa, Artificial Sequence; identical to SEQ ID NO: 37729
  Description of Artificial Sequence: Synthetic polypeptide

SEQ ID NO: 37733 - protein, 107 aa, Artificial Sequence [sequence omitted]

SEQ ID NO: 37734 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQKSLSLSPGK

SEQ ID NO: 37735 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 37736 - protein, 107 aa, Artificial Sequence [sequence omitted]

SEQ ID NO: 37737 - protein, 329 aa, Artificial Sequence; identical to SEQ ID NO: 37725
  Description of Artificial Sequence: Synthetic polypeptide

SEQ ID NO: 37738 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37739 - protein, 107 aa, Artificial Sequence [sequence omitted]

SEQ ID NO: 37740 - protein, 329 aa, Artificial Sequence; identical to SEQ ID NO: 37725
  Description of Artificial Sequence: Synthetic polypeptide

SEQ ID NO: 37741 - protein, 231 aa, Artificial Sequence; identical to SEQ ID NO: 21532
  Description of Artificial Sequence: Synthetic polypeptide

SEQ ID NO: 37742 - protein, 107 aa, Artificial Sequence [sequence omitted]

SEQ ID NO: 37743 - protein, 329 aa, Artificial Sequence; identical to SEQ ID NO: 37725
  Description of Artificial Sequence: Synthetic polypeptide

SEQ ID NO: 37744 - protein, 231 aa, Artificial Sequence; identical to SEQ ID NO: 37729
  Description of Artificial Sequence: Synthetic polypeptide

SEQ ID NO: 37745 - protein, 107 aa, Artificial Sequence [sequence omitted]

SEQ ID NO: 37746 - protein, 329 aa, Artificial Sequence; identical to SEQ ID NO: 37731
  Description of Artificial Sequence: Synthetic polypeptide

SEQ ID NO: 37747 - protein, 231 aa, Artificial Sequence; identical to SEQ ID NO: 37729
  Description of Artificial Sequence: Synthetic polypeptide

SEQ ID NO: 37748 - protein, 107 aa, Artificial Sequence [sequence omitted]

SEQ ID NO: 37749 - protein, 330 aa, Artificial Sequence; identical to SEQ ID NO: 37734
  Description of Artificial Sequence: Synthetic polypeptide

SEQ ID NO: 37750 - protein, 231 aa, Artificial Sequence; identical to SEQ ID NO: 37735
  Description of Artificial Sequence: Synthetic polypeptide

SEQ ID NO: 37751 - protein, 107 aa, Artificial Sequence [sequence omitted]

SEQ ID NO: 37752 - protein, 329 aa, Artificial Sequence; identical to SEQ ID NO: 37725
  Description of Artificial Sequence: Synthetic polypeptide

SEQ ID NO: 37753 - protein, 329 aa, Artificial Sequence; identical to SEQ ID NO: 37738
  Description of Artificial Sequence: Synthetic polypeptide

SEQ ID NO: 37754 - protein, 107 aa, Artificial Sequence [sequence omitted]

SEQ ID NO: 37755 - protein, 20 aa, Artificial Sequence
  Description of Artificial Sequence: Synthetic peptide
GKPGSGKPGSGKPGSGKPGS

SEQ ID NO: 37756 - protein, 5 aa, Artificial Sequence
  Description of Artificial Sequence: Synthetic peptide
GSGGS

SEQ ID NO: 37757 - protein, 5 aa, Artificial Sequence
  Description of Artificial Sequence: Synthetic peptide
GGGGS

SEQ ID NO: 37758 - protein, 4 aa, Artificial Sequence
  Description of Artificial Sequence: Synthetic peptide
GGGS

SEQ ID NO: 37759 - protein, 122 aa, Artificial Sequence; identical to SEQ ID NO: 10908
  Description of Artificial Sequence: Synthetic polypeptide
  VH of XENP19690

SEQ ID NO: 37760 - protein, 5 aa, Artificial Sequence
  Description of Artificial Sequence: Synthetic peptide
  XENP19690 vhCDR1
NYWMN

SEQ ID NO: 37761 - protein, 19 aa, Artificial Sequence
  Description of Artificial Sequence: Synthetic peptide
  XENP19690 vhCDR2
EIRLYSNNYATHYAESVKG

SEQ ID NO: 37762 - protein, 11 aa, Artificial Sequence
  Description of Artificial Sequence: Synthetic peptide
  XENP19690 vhCDR3
YYGNYGGYFDV

SEQ ID NO: 37763 - protein, 107 aa, Artificial Sequence; identical to SEQ ID NO: 10999
  Description of Artificial Sequence: Synthetic polypeptide
  VL of XENP19690

SEQ ID NO: 37764 - protein, 11 aa, Artificial Sequence
  Description of Artificial Sequence: Synthetic peptide
  XENP19690 vlCDR1
RASQSVGNDVA

SEQ ID NO: 37765 - protein, 7 aa, Artificial Sequence
  Description of Artificial Sequence: Synthetic peptide
  XENP19690 vlCDR2
YASHRYT

SEQ ID NO: 37766 - protein, 9 aa, Artificial Sequence
  Description of Artificial Sequence: Synthetic peptide
  XENP19690 vlCDR3
QQDFSSPRT

SEQ ID NO: 37767 - protein, 249 aa, Artificial Sequence; identical to SEQ ID NO: 11375
  Description of Artificial Sequence: Synthetic polypeptide
  scFV of XENP19690

SEQ ID NO: 37768 - protein, 122 aa, Artificial Sequence; identical to SEQ ID NO: 10917
  Description of Artificial Sequence: Synthetic polypeptide
  VH of XENP21215

SEQ ID NO: 37769 - protein, 5 aa, Artificial Sequence
  Description of Artificial Sequence: Synthetic peptide
  XENP21215 vhCDR1
NYWMN

SEQ ID NO: 37770 - protein, 19 aa, Artificial Sequence
  Description of Artificial Sequence: Synthetic peptide
  XENP21215 vhCDR2
EIRLYSNNYATHYAESVKG

SEQ ID NO: 37771 - protein, 11 aa, Artificial Sequence
  Description of Artificial Sequence: Synthetic peptide
  XENP21215 vhCDR3
YYGNYGGYFDV

SEQ ID NO: 37772 - protein, 107 aa, Artificial Sequence; identical to SEQ ID NO: 22811
  Description of Artificial Sequence: Synthetic polypeptide
  VL of XENP21215

SEQ ID NO: 37773 - protein, 11 aa, Artificial Sequence
  Description of Artificial Sequence: Synthetic peptide
  XENP21215 vlCDR1
RASQSVGNDVA

SEQ ID NO: 37774 - protein, 7 aa, Artificial Sequence
  Description of Artificial Sequence: Synthetic peptide
  XENP21215 vlCDR2
YASHRYT

SEQ ID NO: 37775 - protein, 9 aa, Artificial Sequence
  Description of Artificial Sequence: Synthetic peptide
  XENP21215 vlCDR3
QQDWSSPRT

SEQ ID NO: 37776 - protein, 249 aa, Artificial Sequence
  Description of Artificial Sequence: Synthetic polypeptide
  scFV of XENP21215
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 37777 - protein, 107 aa, Artificial Sequence; identical to SEQ ID NO: 10999
  Description of Artificial Sequence: Synthetic polypeptide
  VL of XENP19692

SEQ ID NO: 37778 - protein, 11 aa, Artificial Sequence
  Description of Artificial Sequence: Synthetic peptide
  XENP19692 vlCDR1
RASQSVGNDVA

SEQ ID NO: 37779 - protein, 7 aa, Artificial Sequence
  Description of Artificial Sequence: Synthetic peptide
  XENP19692 vlCDR2
YASHRYT

SEQ ID NO: 37780 - protein, 9 aa, Artificial Sequence
  Description of Artificial Sequence: Synthetic peptide
  XENP19692 vlCDR3
QQDFSSPRT

SEQ ID NO: 37781 - protein, 122 aa, Artificial Sequence; identical to SEQ ID NO: 10908
  Description of Artificial Sequence: Synthetic polypeptide
  VH of XENP19692

SEQ ID NO: 37782 - protein, 5 aa, Artificial Sequence
  Description of Artificial Sequence: Synthetic peptide
  XENP19692 vhCDR1
NYWMN

SEQ ID NO: 37783 - protein, 19 aa, Artificial Sequence
  Description of Artificial Sequence: Synthetic peptide
  XENP19692 vhCDR2
EIRLYSNNYATHYAESVKG

SEQ ID NO: 37784 - protein, 11 aa, Artificial Sequence
  Description of Artificial Sequence: Synthetic peptide
  XENP19692 vhCDR3
YYGNYGGYFDV

SEQ ID NO: 37785 - protein, 249 aa, Artificial Sequence; identical to SEQ ID NO: 11393
  Description of Artificial Sequence: Synthetic polypeptide
  scFV of XENP19692

SEQ ID NO: 37786 - protein, 107 aa, Artificial Sequence; identical to SEQ ID NO: 11359
  Description of Artificial Sequence: Synthetic polypeptide
  VH of XENP19669

SEQ ID NO: 37787 - protein, 11 aa, Artificial Sequence
  Description of Artificial Sequence: Synthetic peptide
  XENP19669 vhCDR1
RASQSVGNDVA

SEQ ID NO: 37788 - protein, 7 aa, Artificial Sequence
  Description of Artificial Sequence: Synthetic peptide
  XENP19669 vhCDR2
YASHRYT

SEQ ID NO: 37789 - protein, 9 aa, Artificial Sequence
  Description of Artificial Sequence: Synthetic peptide
  XENP19669 vhCDR3
QQDFSSPRT

SEQ ID NO: 37790 - protein, 122 aa, Artificial Sequence; identical to SEQ ID NO: 11358
  Description of Artificial Sequence: Synthetic polypeptide
  VL of XENP19669

SEQ ID NO: 37791 - protein, 5 aa, Artificial Sequence
  Description of Artificial Sequence: Synthetic peptide
  XENP19669 vlCDR1
NYWMN

SEQ ID NO: 37792 - protein, 19 aa, Artificial Sequence
  Description of Artificial Sequence: Synthetic peptide
  XENP19669 vlCDR2
EIRLYSNNYATHYAESVKG

SEQ ID NO: 37793 - protein, 11 aa, Artificial Sequence
  Description of Artificial Sequence: Synthetic peptide
  XENP19669 vlCDR3
YYGNYGGYFDV

SEQ ID NO: 37794 - protein, 249 aa, Artificial Sequence; identical to SEQ ID NO: 11366
  Description of Artificial Sequence: Synthetic polypeptide
  scFV of XENP19669

SEQ ID NO: 37795 - protein, 120 aa, Artificial Sequence; identical to SEQ ID NO: 11412
  Description of Artificial Sequence: Synthetic polypeptide
  VH of XENP20162

SEQ ID NO: 37796 - protein, 5 aa, Artificial Sequence
  Description of Artificial Sequence: Synthetic peptide
  XENP20162 vhCDR1
NYWLG

SEQ ID NO: 37797 - protein, 17 aa, Artificial Sequence
  Description of Artificial Sequence: Synthetic peptide
  XENP20162 vhCDR2
NFYPGSSNTYYNEKFQG

SEQ ID NO: 37798 - protein, 11 aa, Artificial Sequence
  Description of Artificial Sequence: Synthetic peptide
  XENP20162 vhCDR3
HYGTNYRYFDV

SEQ ID NO: 37799 - protein, 107 aa, Artificial Sequence; identical to SEQ ID NO: 11413
  Description of Artificial Sequence: Synthetic polypeptide
  VL of XENP20162

SEQ ID NO: 37800 - protein, 11 aa, Artificial Sequence
  Description of Artificial Sequence: Synthetic peptide
  XENP20162 vlCDR1
RASQSVSNDVA

SEQ ID NO: 37801 - protein, 7 aa, Artificial Sequence
  Description of Artificial Sequence: Synthetic peptide
  XENP20162 vlCDR2
YASNRYT

SEQ ID NO: 37802 - protein, 9 aa, Artificial Sequence
  Description of Artificial Sequence: Synthetic peptide
  XENP20162 vlCDR3
QQDYSSPYT

SEQ ID NO: 37803 - protein, 247 aa, Artificial Sequence; identical to SEQ ID NO: 11411
  Description of Artificial Sequence: Synthetic polypeptide
  scFV of XENP20162

SEQ ID NO: 37804 - protein, 118 aa, Artificial Sequence; identical to SEQ ID NO: 409
  Description of Artificial Sequence: Synthetic polypeptide
  VH of [CTLA-4]_H0.25_L0 Anti-CTLA-4 Fv sequences (XENP19235 Fab, XENP19769 scFv)

SEQ ID NO: 37805 - protein, 5 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR1
SYAMH

SEQ ID NO: 37806 - protein, 17 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR2
FISYDGNNKYYADSVKG

SEQ ID NO: 37807 - protein, 9 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vhCDR3
TGWLGPFDY

SEQ ID NO: 37808 - protein, 108 aa, Artificial Sequence; identical to SEQ ID NO: 23
  Description of Artificial Sequence: Synthetic polypeptide
  VL of [CTLA-4]_H0.25_L0 Anti-CTLA-4 Fv sequences (XENP19235 Fab, XENP19769 scFv)

SEQ ID NO: 37809 - protein, 12 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR1
RASQSVGSSYLA

SEQ ID NO: 37810 - protein, 7 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR2
GAFSRAT

SEQ ID NO: 37811 - protein, 9 aa, Artificial Sequence
  Description of Artificial Sequence: Synthetic peptide
  [CTLA-4]_H0.25_L0 Anti-CTLA-4 Fv sequences (XENP19235 Fab, XENP19769 scFv) vlCDR3
QQYGSSPWT

SEQ ID NO: 37812 - protein, 246 aa, Artificial Sequence; identical to SEQ ID NO: 408
  Description of Artificial Sequence: Synthetic polypeptide
  scFV of [CTLA-4]_H0.25_L0 Anti-CTLA-4 Fv sequences (XENP19235 Fab, XENP19769 scFv)

SEQ ID NO: 37813 - protein, 118 aa, Artificial Sequence; identical to SEQ ID NO: 418
  Description of Artificial Sequence: Synthetic polypeptide
  VH of [CTLA-4]_H0.26_L0 Anti-CTLA-4 Fv sequences (XENP19236 Fab, XENP19770 scFv)

SEQ ID NO: 37814 - protein, 5 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR1
SYGMH

SEQ ID NO: 37815 - protein, 17 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR2
FISYDGNNKYYADSVKG

SEQ ID NO: 37816 - protein, 9 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vhCDR3
TGWLGPFDY

SEQ ID NO: 37817 - protein, 108 aa, Artificial Sequence; identical to SEQ ID NO: 23
  Description of Artificial Sequence: Synthetic polypeptide
  VL of [CTLA-4]_H0.26_L0 Anti-CTLA-4 Fv sequences (XENP19236 Fab, XENP19770 scFv)

SEQ ID NO: 37818 - protein, 12 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR1
RASQSVGSSYLA

SEQ ID NO: 37819 - protein, 7 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR2
GAFSRAT

SEQ ID NO: 37820 - protein, 9 aa, Artificial Sequence
  Description of Artificial Sequence: Synthetic peptide
  [CTLA-4]_H0.26_L0 Anti-CTLA-4 Fv sequences (XENP19236 Fab, XENP19770 scFv) vlCDR3
QQYGSSPWT

SEQ ID NO: 37821 - protein, 246 aa, Artificial Sequence; identical to SEQ ID NO: 417
  Description of Artificial Sequence: Synthetic polypeptide
  scFV of [CTLA-4]_H0.26_L0 Anti-CTLA-4 Fv sequences (XENP19236 Fab, XENP19770 scFv)

SEQ ID NO: 37822 - protein, 118 aa, Artificial Sequence; identical to SEQ ID NO: 427
  Description of Artificial Sequence: Synthetic polypeptide
  VH of [CTLA-4]_H0.27_L0 Anti-CTLA-4 Fv sequences (XENP19237 Fab, XENP19771 scFv)

SEQ ID NO: 37823 - protein, 5 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR1
SYSMH

SEQ ID NO: 37824 - protein, 17 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR2
FISYDGNNKYYADSVKG

SEQ ID NO: 37825 - protein, 9 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vhCDR3
TGWLGPFDY

SEQ ID NO: 37826 - protein, 108 aa, Artificial Sequence; identical to SEQ ID NO: 23
  Description of Artificial Sequence: Synthetic polypeptide
  VL of [CTLA-4]_H0.27_L0 Anti-CTLA-4 Fv sequences (XENP19237 Fab, XENP19771 scFv)

SEQ ID NO: 37827 - protein, 12 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR1
RASQSVGSSYLA

SEQ ID NO: 37828 - protein, 7 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR2
GAFSRAT

SEQ ID NO: 37829 - protein, 9 aa, Artificial Sequence
  Description of Artificial Sequence: Synthetic peptide
  [CTLA-4]_H0.27_L0 Anti-CTLA-4 Fv sequences (XENP19237 Fab, XENP19771 scFv) vlCDR3
QQYGSSPWT

SEQ ID NO: 37830 - protein, 246 aa, Artificial Sequence; identical to SEQ ID NO: 426
  Description of Artificial Sequence: Synthetic polypeptide
  scFV of [CTLA-4]_H0.27_L0 Anti-CTLA-4 Fv sequences (XENP19237 Fab, XENP19771 scFv)

SEQ ID NO: 37831 - protein, 246 aa, Artificial Sequence; identical to SEQ ID NO: 444
  Description of Artificial Sequence: Synthetic polypeptide
  scFV of [CTLA-4]_H0.29_L0 Fab XENP19773, scFv XENP19239

SEQ ID NO: 37832 - protein, 118 aa, Artificial Sequence; identical to SEQ ID NO: 526
  Description of Artificial Sequence: Synthetic polypeptide
  VH of [CTLA-4]_H0.38_L0 (Fab XENP19248, scFv XENP19782)

SEQ ID NO: 37833 - protein, 5 aa, Artificial Sequence
  Description of Artificial Sequence: Synthetic peptide
  [CTLA-4]_H0.38_L0 (Fab XENP19248, scFv XENP19782) vhCDR1
SYTMH

SEQ ID NO: 37834 - protein, 17 aa, Artificial Sequence
  Description of Artificial Sequence: Synthetic peptide
  [CTLA-4]_H0.38_L0 (Fab XENP19248, scFv XENP19782) vhCDR2
FISYDGNNKYYADSVKG

SEQ ID NO: 37835 - protein, 9 aa, Artificial Sequence
  Description of Artificial Sequence: Synthetic peptide
  [CTLA-4]_H0.38_L0 (Fab XENP19248, scFv XENP19782) vhCDR3
TGWLGPFDY

SEQ ID NO: 37836 - protein, 108 aa, Artificial Sequence; identical to SEQ ID NO: 23
  Description of Artificial Sequence: Synthetic polypeptide
  VL of [CTLA-4]_H0.38_L0 (Fab XENP19248, scFv XENP19782)

SEQ ID NO: 37837 - protein, 12 aa, Artificial Sequence
  Description of Artificial Sequence: Synthetic peptide
  [CTLA-4]_H0.38_L0 (Fab XENP19248, scFv XENP19782) vlCDR1
RASQSVGSSYLA

SEQ ID NO: 37838 - protein, 7 aa, Artificial Sequence
  Description of Artificial Sequence: Synthetic peptide
  [CTLA-4]_H0.38_L0 (Fab XENP19248, scFv XENP19782) vlCDR2
GAFSRAT

SEQ ID NO: 37839 - protein, 9 aa, Artificial Sequence
  Description of Artificial Sequence: Synthetic peptide
  [CTLA-4]_H0.38_L0 (Fab XENP19248, scFv XENP19782) vlCDR3
QQYGSSPWT

SEQ ID NO: 37840 - protein, 246 aa, Artificial Sequence; identical to SEQ ID NO: 525
  Description of Artificial Sequence: Synthetic polypeptide
  scFV of [CTLA-4]_H0.38_L0 (Fab XENP19248, scFv XENP19782)

SEQ ID NO: 37841 - protein, 118 aa, Artificial Sequence; identical to SEQ ID NO: 535
  Description of Artificial Sequence: Synthetic polypeptide
  VH of [CTLA-4]_H0.39_L0 (Fab XENP19249, scFv XENP19783)

SEQ ID NO: 37842 - protein, 5 aa, Artificial Sequence
  Description of Artificial Sequence: Synthetic peptide
  [CTLA-4]_H0.39_L0 (Fab XENP19249, scFv XENP19783) vhCDR1
SYTMH

SEQ ID NO: 37843 - protein, 17 aa, Artificial Sequence
  Description of Artificial Sequence: Synthetic peptide
  [CTLA-4]_H0.39_L0 (Fab XENP19249, scFv XENP19783) vhCDR2
FISYDGNNKYYADSVKG

SEQ ID NO: 37844 - protein, 9 aa, Artificial Sequence
  Description of Artificial Sequence: Synthetic peptide
  [CTLA-4]_H0.39_L0 (Fab XENP19249, scFv XENP19783) vhCDR3
TGWLGPFDY

SEQ ID NO: 37845 - protein, 108 aa, Artificial Sequence; identical to SEQ ID NO: 23
  Description of Artificial Sequence: Synthetic polypeptide
  VL of [CTLA-4]_H0.39_L0 (Fab XENP19249, scFv XENP19783)

SEQ ID NO: 37846 - protein, 12 aa, Artificial Sequence
  Description of Artificial Sequence: Synthetic peptide
  [CTLA-4]_H0.39_L0 (Fab XENP19249, scFv XENP19783) vlCDR1
RASQSVGSSYLA

SEQ ID NO: 37847 - protein, 7 aa, Artificial Sequence
  Description of Artificial Sequence: Synthetic peptide
  [CTLA-4]_H0.39_L0 (Fab XENP19249, scFv XENP19783) vlCDR2
GAFSRAT

SEQ ID NO: 37848 - protein, 9 aa, Artificial Sequence
  Description of Artificial Sequence: Synthetic peptide
  [CTLA-4]_H0.39_L0 (Fab XENP19249, scFv XENP19783) vlCDR3
QQYGSSPWT

SEQ ID NO: 37849 - protein, 246 aa, Artificial Sequence; identical to SEQ ID NO: 534
  Description of Artificial Sequence: Synthetic polypeptide
  scFV of [CTLA-4]_H0.39_L0 (Fab XENP19249, scFv XENP19783)

SEQ ID NO: 37850 - protein, 118 aa, Artificial Sequence; identical to SEQ ID NO: 544
  Description of Artificial Sequence: Synthetic polypeptide
  VH of [CTLA-4]_H0.40_L0 (Fab XENP19250, scFv XENP19784)

SEQ ID NO: 37851 - protein, 5 aa, Artificial Sequence
  Description of Artificial Sequence: Synthetic peptide
  [CTLA-4]_H0.40_L0 (Fab XENP19250, scFv XENP19784) vhCDR1
SYTMH

SEQ ID NO: 37852 - protein, 17 aa, Artificial Sequence
  Description of Artificial Sequence: Synthetic peptide
  [CTLA-4]_H0.40_L0 (Fab XENP19250, scFv XENP19784) vhCDR2
FISYDGNNKYYADSVKG

SEQ ID NO: 37853 - protein, 9 aa, Artificial Sequence
  Description of Artificial Sequence: Synthetic peptide
  [CTLA-4]_H0.40_L0 (Fab XENP19250, scFv XENP19784) vhCDR3
TGWLGPFDY

SEQ ID NO: 37854 - protein, 108 aa, Artificial Sequence; identical to SEQ ID NO: 23
  Description of Artificial Sequence: Synthetic polypeptide
  VL of [CTLA-4]_H0.40_L0 (Fab XENP19250, scFv XENP19784)

SEQ ID NO: 37855 - protein, 12 aa, Artificial Sequence
  Description of Artificial Sequence: Synthetic peptide
  [CTLA-4]_H0.40_L0 (Fab XENP19250, scFv XENP19784) vlCDR1
RASQSVGSSYLA

SEQ ID NO: 37856 - protein, 7 aa, Artificial Sequence
  Description of Artificial Sequence: Synthetic peptide
  [CTLA-4]_H0.40_L0 (Fab XENP19250, scFv XENP19784) vlCDR2
GAFSRAT

SEQ ID NO: 37857 - protein, 9 aa, Artificial Sequence
  Description of Artificial Sequence: Synthetic peptide
  [CTLA-4]_H0.40_L0 (Fab XENP19250, scFv XENP19784) vlCDR3
QQYGSSPWT

SEQ ID NO: 37858 - protein, 246 aa, Artificial Sequence; identical to SEQ ID NO: 543
  Description of Artificial Sequence: Synthetic polypeptide
  scFV of [CTLA-4]_H0.40_L0 (Fab XENP19250, scFv XENP19784)

SEQ ID NO: 37859 - protein, 118 aa, Artificial Sequence; identical to SEQ ID NO: 814
  Description of Artificial Sequence: Synthetic polypeptide
  VH of [CTLA-4]_H0.70_L0  (Fab XENP19280, scFv XENP19818)

SEQ ID NO: 37860 - protein, 5 aa, Artificial Sequence
  Description of Artificial Sequence: Synthetic peptide
  [CTLA-4]_H0.70_L0  (Fab XENP19280, scFv XENP19818) vhCDR1
SYTMH

SEQ ID NO: 37861 - protein, 17 aa, Artificial Sequence
  Description of Artificial Sequence: Synthetic peptide
  [CTLA-4]_H0.70_L0  (Fab XENP19280, scFv XENP19818) vhCDR2
FISYDGSNKYYADSVKG

SEQ ID NO: 37862 - protein, 9 aa, Artificial Sequence
  Description of Artificial Sequence: Synthetic peptide
  [CTLA-4]_H0.70_L0  (Fab XENP19280, scFv XENP19818) vhCDR3
TGWLGPFDY

SEQ ID NO: 37863 - protein, 108 aa, Artificial Sequence; identical to SEQ ID NO: 23
  Description of Artificial Sequence: Synthetic polypeptide
  VL of [CTLA-4]_H0.70_L0  (Fab XENP19280, scFv XENP19818)

SEQ ID NO: 37864 - protein, 12 aa, Artificial Sequence
  Description of Artificial Sequence: Synthetic peptide
  [CTLA-4]_H0.70_L0  (Fab XENP19280, scFv XENP19818) vlCDR1
RASQSVGSSYLA

SEQ ID NO: 37865 - protein, 7 aa, Artificial Sequence
  Description of Artificial Sequence: Synthetic peptide
  [CTLA-4]_H0.70_L0  (Fab XENP19280, scFv XENP19818) vlCDR2
GAFSRAT

SEQ ID NO: 37866 - protein, 9 aa, Artificial Sequence
  Description of Artificial Sequence: Synthetic peptide
  [CTLA-4]_H0.70_L0  (Fab XENP19280, scFv XENP19818) vlCDR3
QQYGSSPWT

SEQ ID NO: 37867 - protein, 246 aa, Artificial Sequence; identical to SEQ ID NO: 813
  Description of Artificial Sequence: Synthetic polypeptide
  scFV of [CTLA-4]_H0.70_L0  (Fab XENP19280, scFv XENP19818)

SEQ ID NO: 37868 - protein, 118 aa, Artificial Sequence; identical to SEQ ID NO: 22
  Description of Artificial Sequence: Synthetic polypeptide
  VH of [CTLA-4]_H0_L0.22  (Fab XENP19437, scFv XENP19910)

SEQ ID NO: 37869 - protein, 5 aa, Artificial Sequence
  Description of Artificial Sequence: Synthetic peptide
  [CTLA-4]_H0_L0.22  (Fab XENP19437, scFv XENP19910) vhCDR1
SYTMH

SEQ ID NO: 37870 - protein, 17 aa, Artificial Sequence
  Description of Artificial Sequence: Synthetic peptide
  [CTLA-4]_H0_L0.22  (Fab XENP19437, scFv XENP19910) vhCDR2
FISYDGNNKYYADSVKG

SEQ ID NO: 37871 - protein, 9 aa, Artificial Sequence
  Description of Artificial Sequence: Synthetic peptide
  [CTLA-4]_H0_L0.22  (Fab XENP19437, scFv XENP19910) vhCDR3
TGWLGPFDY

SEQ ID NO: 37872 - protein, 108 aa, Artificial Sequence; identical to SEQ ID NO: 1607
  Description of Artificial Sequence: Synthetic polypeptide
  VL of [CTLA-4]_H0_L0.22  (Fab XENP19437, scFv XENP19910)

SEQ ID NO: 37873 - protein, 12 aa, Artificial Sequence
  Description of Artificial Sequence: Synthetic peptide
  [CTLA-4]_H0_L0.22  (Fab XENP19437, scFv XENP19910) vlCDR1
RASQSVSSSYLA

SEQ ID NO: 37874 - protein, 7 aa, Artificial Sequence
  Description of Artificial Sequence: Synthetic peptide
  [CTLA-4]_H0_L0.22  (Fab XENP19437, scFv XENP19910) vlCDR2
GAFSRAT

SEQ ID NO: 37875 - protein, 9 aa, Artificial Sequence
  Description of Artificial Sequence: Synthetic peptide
  [CTLA-4]_H0_L0.22  (Fab XENP19437, scFv XENP19910) vlCDR3
QQYGSSPWT

SEQ ID NO: 37876 - protein, 246 aa, Artificial Sequence; identical to SEQ ID NO: 1605
  Description of Artificial Sequence: Synthetic polypeptide
  scFV of [CTLA-4]_H0_L0.22  (Fab XENP19437, scFv XENP19910)

SEQ ID NO: 37877 - protein, 118 aa, Artificial Sequence; identical to SEQ ID NO: 130
  Description of Artificial Sequence: Synthetic polypeptide
  VH of [CTLA-4]_H2_L0  (Fab XENP,19545 scFv XENP19552)

SEQ ID NO: 37878 - protein, 5 aa, Artificial Sequence
  Description of Artificial Sequence: Synthetic peptide
  [CTLA-4]_H2_L0  (Fab XENP,19545 scFv XENP19552) vhCDR1
SYTMH

SEQ ID NO: 37879 - protein, 17 aa, Artificial Sequence
  Description of Artificial Sequence: Synthetic peptide
  [CTLA-4]_H2_L0  (Fab XENP,19545 scFv XENP19552) vhCDR2
FISYDGNNKYYPGSVKG

SEQ ID NO: 37880 - protein, 9 aa, Artificial Sequence
  Description of Artificial Sequence: Synthetic peptide
  [CTLA-4]_H2_L0  (Fab XENP,19545 scFv XENP19552) vhCDR3
TGWLGPFDY

SEQ ID NO: 37881 - protein, 108 aa, Artificial Sequence; identical to SEQ ID NO: 23
  Description of Artificial Sequence: Synthetic polypeptide
  VL of [CTLA-4]_H2_L0  (Fab XENP,19545 scFv XENP19552)

SEQ ID NO: 37882 - protein, 12 aa, Artificial Sequence
  Description of Artificial Sequence: Synthetic peptide
  [CTLA-4]_H2_L0  (Fab XENP,19545 scFv XENP19552) vlCDR1
RASQSVGSSYLA

SEQ ID NO: 37883 - protein, 7 aa, Artificial Sequence
  Description of Artificial Sequence: Synthetic peptide
  [CTLA-4]_H2_L0  (Fab XENP,19545 scFv XENP19552) vlCDR2
GAFSRAT

SEQ ID NO: 37884 - protein, 9 aa, Artificial Sequence
  Description of Artificial Sequence: Synthetic peptide
  [CTLA-4]_H2_L0  (Fab XENP,19545 scFv XENP19552) vlCDR3
QQYGSSPWT

SEQ ID NO: 37885 - protein, 246 aa, Artificial Sequence; identical to SEQ ID NO: 129
  Description of Artificial Sequence: Synthetic polypeptide
  scFV of [CTLA-4]_H2_L0  (Fab XENP,19545 scFv XENP19552)

SEQ ID NO: 37886 - protein, 118 aa, Artificial Sequence; identical to SEQ ID NO: 2614
  Description of Artificial Sequence: Synthetic polypeptide
  VH of [CTLA-4]_H3.21_L0.124  (Fab XENP20422, scFv XENP20431)

SEQ ID NO: 37887 - protein, 5 aa, Artificial Sequence
  Description of Artificial Sequence: Synthetic peptide
  [CTLA-4]_H3.21_L0.124  (Fab XENP20422, scFv XENP20431) vhCDR1
SYTMH

SEQ ID NO: 37888 - protein, 17 aa, Artificial Sequence
  Description of Artificial Sequence: Synthetic peptide
  [CTLA-4]_H3.21_L0.124  (Fab XENP20422, scFv XENP20431) vhCDR2
FISYDGNTKYYADSVKG

SEQ ID NO: 37889 - protein, 9 aa, Artificial Sequence
  Description of Artificial Sequence: Synthetic peptide
  [CTLA-4]_H3.21_L0.124  (Fab XENP20422, scFv XENP20431) vhCDR3
GGLLGPFDL

SEQ ID NO: 37890 - protein, 108 aa, Artificial Sequence; identical to SEQ ID NO: 2723
  Description of Artificial Sequence: Synthetic polypeptide
  VL of [CTLA-4]_H3.21_L0.124  (Fab XENP20422, scFv XENP20431)

SEQ ID NO: 37891 - protein, 12 aa, Artificial Sequence
  Description of Artificial Sequence: Synthetic peptide
  [CTLA-4]_H3.21_L0.124  (Fab XENP20422, scFv XENP20431) vlCDR1
RASQSVGSSYLA

SEQ ID NO: 37892 - protein, 7 aa, Artificial Sequence
  Description of Artificial Sequence: Synthetic peptide
  [CTLA-4]_H3.21_L0.124  (Fab XENP20422, scFv XENP20431) vlCDR2
GASSRAT

SEQ ID NO: 37893 - protein, 9 aa, Artificial Sequence
  Description of Artificial Sequence: Synthetic peptide
  [CTLA-4]_H3.21_L0.124  (Fab XENP20422, scFv XENP20431) vlCDR3
QQYGSSPWT

SEQ ID NO: 37894 - protein, 246 aa, Artificial Sequence; identical to SEQ ID NO: 2838
  Description of Artificial Sequence: Synthetic polypeptide
  scFV of [CTLA-4]_H3.21_L0.124  (Fab XENP20422, scFv XENP20431)

SEQ ID NO: 37895 - protein, 118 aa, Artificial Sequence; identical to SEQ ID NO: 2614
  Description of Artificial Sequence: Synthetic polypeptide
  VH of [CTLA-4]_H3.21_L0.129  (Fab XENP20423, scFv XENP20432)

SEQ ID NO: 37896 - protein, 5 aa, Artificial Sequence
  Description of Artificial Sequence: Synthetic peptide
  [CTLA-4]_H3.21_L0.129  (Fab XENP20423, scFv XENP20432) vhCDR1
SYTMH

SEQ ID NO: 37897 - protein, 17 aa, Artificial Sequence
  Description of Artificial Sequence: Synthetic peptide
  [CTLA-4]_H3.21_L0.129  (Fab XENP20423, scFv XENP20432) vhCDR2
FISYDGNTKYYADSVKG

SEQ ID NO: 37898 - protein, 9 aa, Artificial Sequence
  Description of Artificial Sequence: Synthetic peptide
  [CTLA-4]_H3.21_L0.129  (Fab XENP20423, scFv XENP20432) vhCDR3
GGLLGPFDL

SEQ ID NO: 37899 - protein, 108 aa, Artificial Sequence; identical to SEQ ID NO: 2768
  Description of Artificial Sequence: Synthetic polypeptide
  VL of [CTLA-4]_H3.21_L0.129  (Fab XENP20423, scFv XENP20432)

SEQ ID NO: 37900 - protein, 12 aa, Artificial Sequence
  Description of Artificial Sequence: Synthetic peptide
  [CTLA-4]_H3.21_L0.129  (Fab XENP20423, scFv XENP20432) vlCDR1
RASQSVGSSYLA

SEQ ID NO: 37901 - protein, 7 aa, Artificial Sequence
  Description of Artificial Sequence: Synthetic peptide
  [CTLA-4]_H3.21_L0.129  (Fab XENP20423, scFv XENP20432) vlCDR2
GASSRAT

SEQ ID NO: 37902 - protein, 9 aa, Artificial Sequence
  Description of Artificial Sequence: Synthetic peptide
  [CTLA-4]_H3.21_L0.129  (Fab XENP20423, scFv XENP20432) vlCDR3
QQYGSSPWT

SEQ ID NO: 37903 - protein, 246 aa, Artificial Sequence; identical to SEQ ID NO: 2847
  Description of Artificial Sequence: Synthetic polypeptide
  scFV of [CTLA-4]_H3.21_L0.129  (Fab XENP20423, scFv XENP20432)

SEQ ID NO: 37904 - protein, 118 aa, Artificial Sequence; identical to SEQ ID NO: 2614
  Description of Artificial Sequence: Synthetic polypeptide
  VH of [CTLA-4]_H3.21_L0.132  (Fab XENP20424, scFv XENP20433)

SEQ ID NO: 37905 - protein, 5 aa, Artificial Sequence
  Description of Artificial Sequence: Synthetic peptide
  [CTLA-4]_H3.21_L0.132  (Fab XENP20424, scFv XENP20433) vhCDR1
SYTMH

SEQ ID NO: 37906 - protein, 17 aa, Artificial Sequence
  Description of Artificial Sequence: Synthetic peptide
  [CTLA-4]_H3.21_L0.132  (Fab XENP20424, scFv XENP20433) vhCDR2
FISYDGNTKYYADSVKG

SEQ ID NO: 37907 - protein, 9 aa, Artificial Sequence
  Description of Artificial Sequence: Synthetic peptide
  [CTLA-4]_H3.21_L0.132  (Fab XENP20424, scFv XENP20433) vhCDR3
GGLLGPFDL

SEQ ID NO: 37908 - protein, 108 aa, Artificial Sequence; identical to SEQ ID NO: 2795
  Description of Artificial Sequence: Synthetic polypeptide
  VL of [CTLA-4]_H3.21_L0.132  (Fab XENP20424, scFv XENP20433)

SEQ ID NO: 37909 - protein, 12 aa, Artificial Sequence
  Description of Artificial Sequence: Synthetic peptide
  [CTLA-4]_H3.21_L0.132  (Fab XENP20424, scFv XENP20433) vlCDR1
RASQSVSSSYLA

SEQ ID NO: 37910 - protein, 7 aa, Artificial Sequence
  Description of Artificial Sequence: Synthetic peptide
  [CTLA-4]_H3.21_L0.132  (Fab XENP20424, scFv XENP20433) vlCDR2
GASSRAT

SEQ ID NO: 37911 - protein, 9 aa, Artificial Sequence
  Description of Artificial Sequence: Synthetic peptide
  [CTLA-4]_H3.21_L0.132  (Fab XENP20424, scFv XENP20433) vlCDR3
QQYGSSPWT

SEQ ID NO: 37912 - protein, 246 aa, Artificial Sequence; identical to SEQ ID NO: 2856
  Description of Artificial Sequence: Synthetic polypeptide
  scFV of [CTLA-4]_H3.21_L0.132  (Fab XENP20424, scFv XENP20433)

SEQ ID NO: 37913 - protein, 118 aa, Artificial Sequence; identical to SEQ ID NO: 2632
  Description of Artificial Sequence: Synthetic polypeptide
  VH of [CTLA-4]_H3.23_L0.124  (Fab XENP20425, scFv XENP20434)

SEQ ID NO: 37914 - protein, 5 aa, Artificial Sequence
  Description of Artificial Sequence: Synthetic peptide
  [CTLA-4]_H3.23_L0.124  (Fab XENP20425, scFv XENP20434) vhCDR1
SYTMH

SEQ ID NO: 37915 - protein, 17 aa, Artificial Sequence
  Description of Artificial Sequence: Synthetic peptide
  [CTLA-4]_H3.23_L0.124  (Fab XENP20425, scFv XENP20434) vhCDR2
FISYDGNYKYYADSVKG

SEQ ID NO: 37916 - protein, 9 aa, Artificial Sequence
  Description of Artificial Sequence: Synthetic peptide
  [CTLA-4]_H3.23_L0.124  (Fab XENP20425, scFv XENP20434) vhCDR3
GGHLGPFDL

SEQ ID NO: 37917 - protein, 108 aa, Artificial Sequence; identical to SEQ ID NO: 2723
  Description of Artificial Sequence: Synthetic polypeptide
  VL of [CTLA-4]_H3.23_L0.124  (Fab XENP20425, scFv XENP20434)

SEQ ID NO: 37918 - protein, 12 aa, Artificial Sequence
  Description of Artificial Sequence: Synthetic peptide
  [CTLA-4]_H3.23_L0.124  (Fab XENP20425, scFv XENP20434) vlCDR1
RASQSVGSSYLA

SEQ ID NO: 37919 - protein, 7 aa, Artificial Sequence
  Description of Artificial Sequence: Synthetic peptide
  [CTLA-4]_H3.23_L0.124  (Fab XENP20425, scFv XENP20434) vlCDR2
GASSRAT

SEQ ID NO: 37920 - protein, 9 aa, Artificial Sequence
  Description of Artificial Sequence: Synthetic peptide
  [CTLA-4]_H3.23_L0.124  (Fab XENP20425, scFv XENP20434) vlCDR3
QQYGSSPWT

SEQ ID NO: 37921 - protein, 246 aa, Artificial Sequence; identical to SEQ ID NO: 2865
  Description of Artificial Sequence: Synthetic polypeptide
  scFV of [CTLA-4]_H3.23_L0.124  (Fab XENP20425, scFv XENP20434)

SEQ ID NO: 37922 - protein, 118 aa, Artificial Sequence; identical to SEQ ID NO: 2632
  Description of Artificial Sequence: Synthetic polypeptide
  VH of [CTLA-4]_H3.23_L0.129  (Fab XENP20426, scFv XENP20435)

SEQ ID NO: 37923 - protein, 5 aa, Artificial Sequence
  Description of Artificial Sequence: Synthetic peptide
  [CTLA-4]_H3.23_L0.129  (Fab XENP20426, scFv XENP20435) vhCDR1
SYTMH

SEQ ID NO: 37924 - protein, 17 aa, Artificial Sequence
  Description of Artificial Sequence: Synthetic peptide
  [CTLA-4]_H3.23_L0.129  (Fab XENP20426, scFv XENP20435) vhCDR2
FISYDGNYKYYADSVKG

SEQ ID NO: 37925 - protein, 9 aa, Artificial Sequence
  Description of Artificial Sequence: Synthetic peptide
  [CTLA-4]_H3.23_L0.129  (Fab XENP20426, scFv XENP20435) vhCDR3
GGHLGPFDL

SEQ ID NO: 37926 - protein, 108 aa, Artificial Sequence; identical to SEQ ID NO: 2768
  Description of Artificial Sequence: Synthetic polypeptide
  VL of [CTLA-4]_H3.23_L0.129  (Fab XENP20426, scFv XENP20435)

SEQ ID NO: 37927 - protein, 12 aa, Artificial Sequence
  Description of Artificial Sequence: Synthetic peptide
  [CTLA-4]_H3.23_L0.129  (Fab XENP20426, scFv XENP20435) vlCDR1
RASQSVGSSYLA

SEQ ID NO: 37928 - protein, 7 aa, Artificial Sequence
  Description of Artificial Sequence: Synthetic peptide
  [CTLA-4]_H3.23_L0.129  (Fab XENP20426, scFv XENP20435) vlCDR2
GASSRAT

SEQ ID NO: 37929 - protein, 9 aa, Artificial Sequence
  Description of Artificial Sequence: Synthetic peptide
  [CTLA-4]_H3.23_L0.129  (Fab XENP20426, scFv XENP20435) vlCDR3
QQYGSSPWT

SEQ ID NO: 37930 - protein, 246 aa, Artificial Sequence; identical to SEQ ID NO: 2874
  Description of Artificial Sequence: Synthetic polypeptide
  scFV of [CTLA-4]_H3.23_L0.129  (Fab XENP20426, scFv XENP20435)

SEQ ID NO: 37931 - protein, 118 aa, Artificial Sequence; identical to SEQ ID NO: 2632
  Description of Artificial Sequence: Synthetic polypeptide
  VH of [CTLA-4]_H3.23_L0.132  (Fab XENP20427, scFv XENP20436)

SEQ ID NO: 37932 - protein, 5 aa, Artificial Sequence
  Description of Artificial Sequence: Synthetic peptide
  [CTLA-4]_H3.23_L0.132  (Fab XENP20427, scFv XENP20436) vhCDR1
SYTMH

SEQ ID NO: 37933 - protein, 17 aa, Artificial Sequence
  Description of Artificial Sequence: Synthetic peptide
  [CTLA-4]_H3.23_L0.132  (Fab XENP20427, scFv XENP20436) vhCDR2
FISYDGNYKYYADSVKG

SEQ ID NO: 37934 - protein, 9 aa, Artificial Sequence
  Description of Artificial Sequence: Synthetic peptide
  [CTLA-4]_H3.23_L0.132  (Fab XENP20427, scFv XENP20436) vhCDR3
GGHLGPFDL

SEQ ID NO: 37935 - protein, 108 aa, Artificial Sequence; identical to SEQ ID NO: 2795
  Description of Artificial Sequence: Synthetic polypeptide
  VL of [CTLA-4]_H3.23_L0.132  (Fab XENP20427, scFv XENP20436)

SEQ ID NO: 37936 - protein, 12 aa, Artificial Sequence
  Description of Artificial Sequence: Synthetic peptide
  [CTLA-4]_H3.23_L0.132  (Fab XENP20427, scFv XENP20436) vlCDR1
RASQSVSSSYLA

SEQ ID NO: 37937 - protein, 7 aa, Artificial Sequence
  Description of Artificial Sequence: Synthetic peptide
  [CTLA-4]_H3.23_L0.132  (Fab XENP20427, scFv XENP20436) vlCDR2
GASSRAT

SEQ ID NO: 37938 - protein, 9 aa, Artificial Sequence
  Description of Artificial Sequence: Synthetic peptide
  [CTLA-4]_H3.23_L0.132  (Fab XENP20427, scFv XENP20436) vlCDR3
QQYGSSPWT

SEQ ID NO: 37939 - protein, 246 aa, Artificial Sequence; identical to SEQ ID NO: 2883
  Description of Artificial Sequence: Synthetic polypeptide
  scFV of [CTLA-4]_H3.23_L0.132  (Fab XENP20427, scFv XENP20436)

SEQ ID NO: 37940 - protein, 118 aa, Artificial Sequence; identical to SEQ ID NO: 2650
  Description of Artificial Sequence: Synthetic polypeptide
  VH of [CTLA-4]_H3.25_L0.124  (Fab XENP20428, scFv XENP20437)

SEQ ID NO: 37941 - protein, 5 aa, Artificial Sequence
  Description of Artificial Sequence: Synthetic peptide
  [CTLA-4]_H3.25_L0.124  (Fab XENP20428, scFv XENP20437) vhCDR1
SYTMH

SEQ ID NO: 37942 - protein, 17 aa, Artificial Sequence
  Description of Artificial Sequence: Synthetic peptide
  [CTLA-4]_H3.25_L0.124  (Fab XENP20428, scFv XENP20437) vhCDR2
FISYDGNYKYYADSVKG

SEQ ID NO: 37943 - protein, 9 aa, Artificial Sequence
  Description of Artificial Sequence: Synthetic peptide
  [CTLA-4]_H3.25_L0.124  (Fab XENP20428, scFv XENP20437) vhCDR3
GGLLGPFDL

SEQ ID NO: 37944 - protein, 108 aa, Artificial Sequence; identical to SEQ ID NO: 2723
  Description of Artificial Sequence: Synthetic polypeptide
  VL of [CTLA-4]_H3.25_L0.124  (Fab XENP20428, scFv XENP20437)

SEQ ID NO: 37945 - protein, 12 aa, Artificial Sequence
  Description of Artificial Sequence: Synthetic peptide
  [CTLA-4]_H3.25_L0.124  (Fab XENP20428, scFv XENP20437) vlCDR1
RASQSVGSSYLA

SEQ ID NO: 37946 - protein, 7 aa, Artificial Sequence
  Description of Artificial Sequence: Synthetic peptide
  [CTLA-4]_H3.25_L0.124  (Fab XENP20428, scFv XENP20437) vlCDR2
GASSRAT

SEQ ID NO: 37947 - protein, 9 aa, Artificial Sequence
  Description of Artificial Sequence: Synthetic peptide
  [CTLA-4]_H3.25_L0.124  (Fab XENP20428, scFv XENP20437) vlCDR3
QQYGSSPWT

SEQ ID NO: 37948 - protein, 246 aa, Artificial Sequence; identical to SEQ ID NO: 2892
  Description of Artificial Sequence: Synthetic polypeptide
  scFV of [CTLA-4]_H3.25_L0.124  (Fab XENP20428, scFv XENP20437)

SEQ ID NO: 37949 - protein, 118 aa, Artificial Sequence; identical to SEQ ID NO: 2650
  Description of Artificial Sequence: Synthetic polypeptide
  VH of [CTLA-4]_H3.25_L0.129  (Fab XENP20429, scFv XENP20438)

SEQ ID NO: 37950 - protein, 5 aa, Artificial Sequence
  Description of Artificial Sequence: Synthetic peptide
  [CTLA-4]_H3.25_L0.129  (Fab XENP20429, scFv XENP20438) vhCDR1
SYTMH

SEQ ID NO: 37951 - protein, 17 aa, Artificial Sequence
  Description of Artificial Sequence: Synthetic peptide
  [CTLA-4]_H3.25_L0.129  (Fab XENP20429, scFv XENP20438) vhCDR2
FISYDGNYKYYADSVKG

SEQ ID NO: 37952 - protein, 9 aa, Artificial Sequence
  Description of Artificial Sequence: Synthetic peptide
  [CTLA-4]_H3.25_L0.129  (Fab XENP20429, scFv XENP20438) vhCDR3
GGLLGPFDL

SEQ ID NO: 37953 - protein, 108 aa, Artificial Sequence; identical to SEQ ID NO: 2768
  Description of Artificial Sequence: Synthetic polypeptide
  VL of [CTLA-4]_H3.25_L0.129  (Fab XENP20429, scFv XENP20438)

SEQ ID NO: 37954 - protein, 12 aa, Artificial Sequence
  Description of Artificial Sequence: Synthetic peptide
  [CTLA-4]_H3.25_L0.129  (Fab XENP20429, scFv XENP20438) vlCDR1
RASQSVGSSYLA

SEQ ID NO: 37955 - protein, 7 aa, Artificial Sequence
  Description of Artificial Sequence: Synthetic peptide
  [CTLA-4]_H3.25_L0.129  (Fab XENP20429, scFv XENP20438) vlCDR2
GASSRAT

SEQ ID NO: 37956 - protein, 9 aa, Artificial Sequence
  Description of Artificial Sequence: Synthetic peptide
  [CTLA-4]_H3.25_L0.129  (Fab XENP20429, scFv XENP20438) vlCDR3
QQYGSSPWT

SEQ ID NO: 37957 - protein, 246 aa, Artificial Sequence; identical to SEQ ID NO: 2901
  Description of Artificial Sequence: Synthetic polypeptide
  scFV of [CTLA-4]_H3.25_L0.129  (Fab XENP20429, scFv XENP20438)

SEQ ID NO: 37958 - protein, 118 aa, Artificial Sequence; identical to SEQ ID NO: 2650
  Description of Artificial Sequence: Synthetic polypeptide
  VH of [CTLA-4]_H3.25_L0.132  (Fab XENP20430, scFv XENP20439)

SEQ ID NO: 37959 - protein, 5 aa, Artificial Sequence
  Description of Artificial Sequence: Synthetic peptide
  [CTLA-4]_H3.25_L0.132  (Fab XENP20430, scFv XENP20439) vhCDR1
SYTMH

SEQ ID NO: 37960 - protein, 17 aa, Artificial Sequence
  Description of Artificial Sequence: Synthetic peptide
  [CTLA-4]_H3.25_L0.132  (Fab XENP20430, scFv XENP20439) vhCDR2
FISYDGNYKYYADSVKG

SEQ ID NO: 37961 - protein, 9 aa, Artificial Sequence
  Description of Artificial Sequence: Synthetic peptide
  [CTLA-4]_H3.25_L0.132  (Fab XENP20430, scFv XENP20439) vhCDR3
GGLLGPFDL

SEQ ID NO: 37962 - protein, 108 aa, Artificial Sequence; identical to SEQ ID NO: 2795
  Description of Artificial Sequence: Synthetic polypeptide
  VL of [CTLA-4]_H3.25_L0.132  (Fab XENP20430, scFv XENP20439)

SEQ ID NO: 37963 - protein, 12 aa, Artificial Sequence
  Description of Artificial Sequence: Synthetic peptide
  [CTLA-4]_H3.25_L0.132  (Fab XENP20430, scFv XENP20439) vlCDR1
RASQSVSSSYLA

SEQ ID NO: 37964 - protein, 7 aa, Artificial Sequence
  Description of Artificial Sequence: Synthetic peptide
  [CTLA-4]_H3.25_L0.132  (Fab XENP20430, scFv XENP20439) vlCDR2
GASSRAT

SEQ ID NO: 37965 - protein, 9 aa, Artificial Sequence
  Description of Artificial Sequence: Synthetic peptide
  [CTLA-4]_H3.25_L0.132  (Fab XENP20430, scFv XENP20439) vlCDR3
QQYGSSPWT

SEQ ID NO: 37966 - protein, 246 aa, Artificial Sequence; identical to SEQ ID NO: 2910
  Description of Artificial Sequence: Synthetic polypeptide
  scFV of [CTLA-4]_H3.25_L0.132  (Fab XENP20430, scFv XENP20439)

SEQ ID NO: 37967 - protein, 118 aa, Artificial Sequence; identical to SEQ ID NO: 2461
  Description of Artificial Sequence: Synthetic polypeptide
  VH of [CTLA-4]_H3.4_L0.118  (Fab XENP20341, scFv XENP20378)

SEQ ID NO: 37968 - protein, 5 aa, Artificial Sequence
  Description of Artificial Sequence: Synthetic peptide
  [CTLA-4]_H3.4_L0.118  (Fab XENP20341, scFv XENP20378) vhCDR1
SYTMH

SEQ ID NO: 37969 - protein, 17 aa, Artificial Sequence
  Description of Artificial Sequence: Synthetic peptide
  [CTLA-4]_H3.4_L0.118  (Fab XENP20341, scFv XENP20378) vhCDR2
FISYDGNHKYYADSVKG

SEQ ID NO: 37970 - protein, 9 aa, Artificial Sequence
  Description of Artificial Sequence: Synthetic peptide
  [CTLA-4]_H3.4_L0.118  (Fab XENP20341, scFv XENP20378) vhCDR3
TGHLGPFDL

SEQ ID NO: 37971 - protein, 108 aa, Artificial Sequence; identical to SEQ ID NO: 2669
  Description of Artificial Sequence: Synthetic polypeptide
  VL of [CTLA-4]_H3.4_L0.118  (Fab XENP20341, scFv XENP20378)

SEQ ID NO: 37972 - protein, 12 aa, Artificial Sequence
  Description of Artificial Sequence: Synthetic peptide
  [CTLA-4]_H3.4_L0.118  (Fab XENP20341, scFv XENP20378) vlCDR1
RASQSVGSSYLA

SEQ ID NO: 37973 - protein, 7 aa, Artificial Sequence
  Description of Artificial Sequence: Synthetic peptide
  [CTLA-4]_H3.4_L0.118  (Fab XENP20341, scFv XENP20378) vlCDR2
GAFSRAT

SEQ ID NO: 37974 - protein, 9 aa, Artificial Sequence
  Description of Artificial Sequence: Synthetic peptide
  [CTLA-4]_H3.4_L0.118  (Fab XENP20341, scFv XENP20378) vlCDR3
QQYGSSPWT

SEQ ID NO: 37975 - protein, 246 aa, Artificial Sequence; identical to SEQ ID NO: 2667
  Description of Artificial Sequence: Synthetic polypeptide
  scFV of [CTLA-4]_H3.4_L0.118  (Fab XENP20341, scFv XENP20378)

SEQ ID NO: 37976 - protein, 118 aa, Artificial Sequence; identical to SEQ ID NO: 2461
  Description of Artificial Sequence: Synthetic polypeptide
  VH of [CTLA-4]_H3.4_L0.119  (Fab XENP20342, scFv XENP20379)

SEQ ID NO: 37977 - protein, 5 aa, Artificial Sequence
  Description of Artificial Sequence: Synthetic peptide
  [CTLA-4]_H3.4_L0.119  (Fab XENP20342, scFv XENP20379) vhCDR1
SYTMH

SEQ ID NO: 37978 - protein, 17 aa, Artificial Sequence
  Description of Artificial Sequence: Synthetic peptide
  [CTLA-4]_H3.4_L0.119  (Fab XENP20342, scFv XENP20379) vhCDR2
FISYDGNHKYYADSVKG

SEQ ID NO: 37979 - protein, 9 aa, Artificial Sequence
  Description of Artificial Sequence: Synthetic peptide
  [CTLA-4]_H3.4_L0.119  (Fab XENP20342, scFv XENP20379) vhCDR3
TGHLGPFDL

SEQ ID NO: 37980 - protein, 108 aa, Artificial Sequence; identical to SEQ ID NO: 23
  Description of Artificial Sequence: Synthetic polypeptide
  VL of [CTLA-4]_H3.4_L0.119  (Fab XENP20342, scFv XENP20379)

SEQ ID NO: 37981 - protein, 12 aa, Artificial Sequence
  Description of Artificial Sequence: Synthetic peptide
  [CTLA-4]_H3.4_L0.119  (Fab XENP20342, scFv XENP20379) vlCDR1
RASQSVGSSYLA

SEQ ID NO: 37982 - protein, 7 aa, Artificial Sequence
  Description of Artificial Sequence: Synthetic peptide
  [CTLA-4]_H3.4_L0.119  (Fab XENP20342, scFv XENP20379) vlCDR2
GAFSRAT

SEQ ID NO: 37983 - protein, 9 aa, Artificial Sequence
  Description of Artificial Sequence: Synthetic peptide
  [CTLA-4]_H3.4_L0.119  (Fab XENP20342, scFv XENP20379) vlCDR3
QQYGSSPWT

SEQ ID NO: 37984 - protein, 246 aa, Artificial Sequence; identical to SEQ ID NO: 2676
  Description of Artificial Sequence: Synthetic polypeptide
  scFV of [CTLA-4]_H3.4_L0.119  (Fab XENP20342, scFv XENP20379)

SEQ ID NO: 37985 - protein, 118 aa, Artificial Sequence; identical to SEQ ID NO: 2461
  Description of Artificial Sequence: Synthetic polypeptide
  VH of [CTLA-4]_H3.4_L0.12  (Fab XENP20071, scFv XENP20078)

SEQ ID NO: 37986 - protein, 5 aa, Artificial Sequence
  Description of Artificial Sequence: Synthetic peptide
  [CTLA-4]_H3.4_L0.12  (Fab XENP20071, scFv XENP20078) vhCDR1
SYTMH

SEQ ID NO: 37987 - protein, 17 aa, Artificial Sequence
  Description of Artificial Sequence: Synthetic peptide
  [CTLA-4]_H3.4_L0.12  (Fab XENP20071, scFv XENP20078) vhCDR2
FISYDGNHKYYADSVKG

SEQ ID NO: 37988 - protein, 9 aa, Artificial Sequence
  Description of Artificial Sequence: Synthetic peptide
  [CTLA-4]_H3.4_L0.12  (Fab XENP20071, scFv XENP20078) vhCDR3
TGHLGPFDL

SEQ ID NO: 37989 - protein, 108 aa, Artificial Sequence; identical to SEQ ID NO: 1517
  Description of Artificial Sequence: Synthetic polypeptide
  VL of [CTLA-4]_H3.4_L0.12  (Fab XENP20071, scFv XENP20078)

SEQ ID NO: 37990 - protein, 12 aa, Artificial Sequence
  Description of Artificial Sequence: Synthetic peptide
  [CTLA-4]_H3.4_L0.12  (Fab XENP20071, scFv XENP20078) vlCDR1
RASQSVGSSYLA

SEQ ID NO: 37991 - protein, 7 aa, Artificial Sequence
  Description of Artificial Sequence: Synthetic peptide
  [CTLA-4]_H3.4_L0.12  (Fab XENP20071, scFv XENP20078) vlCDR2
GAFSRAT

SEQ ID NO: 37992 - protein, 9 aa, Artificial Sequence
  Description of Artificial Sequence: Synthetic peptide
  [CTLA-4]_H3.4_L0.12  (Fab XENP20071, scFv XENP20078) vlCDR3
QQYGSSPWT

SEQ ID NO: 37993 - protein, 246 aa, Artificial Sequence; identical to SEQ ID NO: 2460
  Description of Artificial Sequence: Synthetic polypeptide
  scFV of [CTLA-4]_H3.4_L0.12  (Fab XENP20071, scFv XENP20078)

SEQ ID NO: 37994 - protein, 118 aa, Artificial Sequence; identical to SEQ ID NO: 2461
  Description of Artificial Sequence: Synthetic polypeptide
  VH of [CTLA-4]_H3.4_L0.121  (Fab XENP20344, scFv XENP20381)

SEQ ID NO: 37995 - protein, 5 aa, Artificial Sequence
  Description of Artificial Sequence: Synthetic peptide
  [CTLA-4]_H3.4_L0.121  (Fab XENP20344, scFv XENP20381) vhCDR1
SYTMH

SEQ ID NO: 37996 - protein, 17 aa, Artificial Sequence
  Description of Artificial Sequence: Synthetic peptide
  [CTLA-4]_H3.4_L0.121  (Fab XENP20344, scFv XENP20381) vhCDR2
FISYDGNHKYYADSVKG

SEQ ID NO: 37997 - protein, 9 aa, Artificial Sequence
  Description of Artificial Sequence: Synthetic peptide
  [CTLA-4]_H3.4_L0.121  (Fab XENP20344, scFv XENP20381) vhCDR3
TGHLGPFDL

SEQ ID NO: 37998 - protein, 108 aa, Artificial Sequence; identical to SEQ ID NO: 2696
  Description of Artificial Sequence: Synthetic polypeptide
  VL of [CTLA-4]_H3.4_L0.121  (Fab XENP20344, scFv XENP20381)

SEQ ID NO: 37999 - protein, 12 aa, Artificial Sequence
  Description of Artificial Sequence: Synthetic peptide
  [CTLA-4]_H3.4_L0.121  (Fab XENP20344, scFv XENP20381) vlCDR1
RASQSVGSSYLA

SEQ ID NO: 38000 - protein, 7 aa, Artificial Sequence
  Description of Artificial Sequence: Synthetic peptide
  [CTLA-4]_H3.4_L0.121  (Fab XENP20344, scFv XENP20381) vlCDR2
GASSRAT

SEQ ID NO: 38001 - protein, 9 aa, Artificial Sequence
  Description of Artificial Sequence: Synthetic peptide
  [CTLA-4]_H3.4_L0.121  (Fab XENP20344, scFv XENP20381) vlCDR3
QQYGSSPWT

SEQ ID NO: 38002 - protein, 246 aa, Artificial Sequence; identical to SEQ ID NO: 2694
  Description of Artificial Sequence: Synthetic polypeptide
  scFV of [CTLA-4]_H3.4_L0.121  (Fab XENP20344, scFv XENP20381)

SEQ ID NO: 38003 - protein, 118 aa, Artificial Sequence; identical to SEQ ID NO: 2461
  Description of Artificial Sequence: Synthetic polypeptide
  VH of [CTLA-4]_H3.4_L0.122  (Fab XENP20345, scFv XENP20382)

SEQ ID NO: 38004 - protein, 5 aa, Artificial Sequence
  Description of Artificial Sequence: Synthetic peptide
  [CTLA-4]_H3.4_L0.122  (Fab XENP20345, scFv XENP20382) vhCDR1
SYTMH

SEQ ID NO: 38005 - protein, 17 aa, Artificial Sequence
  Description of Artificial Sequence: Synthetic peptide
  [CTLA-4]_H3.4_L0.122  (Fab XENP20345, scFv XENP20382) vhCDR2
FISYDGNHKYYADSVKG

SEQ ID NO: 38006 - protein, 9 aa, Artificial Sequence
  Description of Artificial Sequence: Synthetic peptide
  [CTLA-4]_H3.4_L0.122  (Fab XENP20345, scFv XENP20382) vhCDR3
TGHLGPFDL

SEQ ID NO: 38007 - protein, 108 aa, Artificial Sequence; identical to SEQ ID NO: 1481
  Description of Artificial Sequence: Synthetic polypeptide
  VL of [CTLA-4]_H3.4_L0.122  (Fab XENP20345, scFv XENP20382)

SEQ ID NO: 38008 - protein, 12 aa, Artificial Sequence
  Description of Artificial Sequence: Synthetic peptide
  [CTLA-4]_H3.4_L0.122  (Fab XENP20345, scFv XENP20382) vlCDR1
RASQSVGSSYLA

SEQ ID NO: 38009 - protein, 7 aa, Artificial Sequence
  Description of Artificial Sequence: Synthetic peptide
  [CTLA-4]_H3.4_L0.122  (Fab XENP20345, scFv XENP20382) vlCDR2
GAFSRAT

SEQ ID NO: 38010 - protein, 9 aa, Artificial Sequence
  Description of Artificial Sequence: Synthetic peptide
  [CTLA-4]_H3.4_L0.122  (Fab XENP20345, scFv XENP20382) vlCDR3
QQYGSSPWT

SEQ ID NO: 38011 - protein, 246 aa, Artificial Sequence; identical to SEQ ID NO: 2703
  Description of Artificial Sequence: Synthetic polypeptide
  scFV of [CTLA-4]_H3.4_L0.122  (Fab XENP20345, scFv XENP20382)

SEQ ID NO: 38012 - protein, 118 aa, Artificial Sequence; identical to SEQ ID NO: 2461
  Description of Artificial Sequence: Synthetic polypeptide
  VH of [CTLA-4]_H3.4_L0.123  (Fab XENP20346, scFv XENP20383)

SEQ ID NO: 38013 - protein, 5 aa, Artificial Sequence
  Description of Artificial Sequence: Synthetic peptide
  [CTLA-4]_H3.4_L0.123  (Fab XENP20346, scFv XENP20383) vhCDR1
SYTMH

SEQ ID NO: 38014 - protein, 17 aa, Artificial Sequence
  Description of Artificial Sequence: Synthetic peptide
  [CTLA-4]_H3.4_L0.123  (Fab XENP20346, scFv XENP20383) vhCDR2
FISYDGNHKYYADSVKG

SEQ ID NO: 38015 - protein, 9 aa, Artificial Sequence
  Description of Artificial Sequence: Synthetic peptide
  [CTLA-4]_H3.4_L0.123  (Fab XENP20346, scFv XENP20383) vhCDR3
TGHLGPFDL

SEQ ID NO: 38016 - protein, 108 aa, Artificial Sequence; identical to SEQ ID NO: 2714
  Description of Artificial Sequence: Synthetic polypeptide
  VL of [CTLA-4]_H3.4_L0.123  (Fab XENP20346, scFv XENP20383)

SEQ ID NO: 38017 - protein, 12 aa, Artificial Sequence
  Description of Artificial Sequence: Synthetic peptide
  [CTLA-4]_H3.4_L0.123  (Fab XENP20346, scFv XENP20383) vlCDR1
RASQSVSSSYLA

SEQ ID NO: 38018 - protein, 7 aa, Artificial Sequence
  Description of Artificial Sequence: Synthetic peptide
  [CTLA-4]_H3.4_L0.123  (Fab XENP20346, scFv XENP20383) vlCDR2
GAFSRAT

SEQ ID NO: 38019 - protein, 9 aa, Artificial Sequence
  Description of Artificial Sequence: Synthetic peptide
  [CTLA-4]_H3.4_L0.123  (Fab XENP20346, scFv XENP20383) vlCDR3
QQYGSSPWT

SEQ ID NO: 38020 - protein, 246 aa, Artificial Sequence; identical to SEQ ID NO: 2712
  Description of Artificial Sequence: Synthetic polypeptide
  scFV of [CTLA-4]_H3.4_L0.123  (Fab XENP20346, scFv XENP20383)

SEQ ID NO: 38021 - protein, 118 aa, Artificial Sequence; identical to SEQ ID NO: 2461
  Description of Artificial Sequence: Synthetic polypeptide
  VH of [CTLA-4]_H3.4_L0.124  (Fab XENP20347, scFv XENP20384)

SEQ ID NO: 38022 - protein, 5 aa, Artificial Sequence
  Description of Artificial Sequence: Synthetic peptide
  [CTLA-4]_H3.4_L0.124  (Fab XENP20347, scFv XENP20384) vhCDR1
SYTMH

SEQ ID NO: 38023 - protein, 17 aa, Artificial Sequence
  Description of Artificial Sequence: Synthetic peptide
  [CTLA-4]_H3.4_L0.124  (Fab XENP20347, scFv XENP20384) vhCDR2
FISYDGNHKYYADSVKG

SEQ ID NO: 38024 - protein, 9 aa, Artificial Sequence
  Description of Artificial Sequence: Synthetic peptide
  [CTLA-4]_H3.4_L0.124  (Fab XENP20347, scFv XENP20384) vhCDR3
TGHLGPFDL

SEQ ID NO: 38025 - protein, 108 aa, Artificial Sequence; identical to SEQ ID NO: 2723
  Description of Artificial Sequence: Synthetic polypeptide
  VL of [CTLA-4]_H3.4_L0.124  (Fab XENP20347, scFv XENP20384)

SEQ ID NO: 38026 - protein, 12 aa, Artificial Sequence
  Description of Artificial Sequence: Synthetic peptide
  [CTLA-4]_H3.4_L0.124  (Fab XENP20347, scFv XENP20384) vlCDR1
RASQSVGSSYLA

SEQ ID NO: 38027 - protein, 7 aa, Artificial Sequence
  Description of Artificial Sequence: Synthetic peptide
  [CTLA-4]_H3.4_L0.124  (Fab XENP20347, scFv XENP20384) vlCDR2
GASSRAT

SEQ ID NO: 38028 - protein, 9 aa, Artificial Sequence
  Description of Artificial Sequence: Synthetic peptide
  [CTLA-4]_H3.4_L0.124  (Fab XENP20347, scFv XENP20384) vlCDR3
QQYGSSPWT

SEQ ID NO: 38029 - protein, 246 aa, Artificial Sequence; identical to SEQ ID NO: 2721
  Description of Artificial Sequence: Synthetic polypeptide
  scFV of [CTLA-4]_H3.4_L0.124  (Fab XENP20347, scFv XENP20384)

SEQ ID NO: 38030 - protein, 118 aa, Artificial Sequence; identical to SEQ ID NO: 2461
  Description of Artificial Sequence: Synthetic polypeptide
  VH of [CTLA-4]_H3.4_L0.125  (Fab XENP20348, scFv XENP20385)

SEQ ID NO: 38031 - protein, 5 aa, Artificial Sequence
  Description of Artificial Sequence: Synthetic peptide
  [CTLA-4]_H3.4_L0.125  (Fab XENP20348, scFv XENP20385) vhCDR1
SYTMH

SEQ ID NO: 38032 - protein, 17 aa, Artificial Sequence
  Description of Artificial Sequence: Synthetic peptide
  [CTLA-4]_H3.4_L0.125  (Fab XENP20348, scFv XENP20385) vhCDR2
FISYDGNHKYYADSVKG

SEQ ID NO: 38033 - protein, 9 aa, Artificial Sequence
  Description of Artificial Sequence: Synthetic peptide
  [CTLA-4]_H3.4_L0.125  (Fab XENP20348, scFv XENP20385) vhCDR3
TGHLGPFDL

SEQ ID NO: 38034 - protein, 108 aa, Artificial Sequence; identical to SEQ ID NO: 1607
  Description of Artificial Sequence: Synthetic polypeptide
  VL of [CTLA-4]_H3.4_L0.125  (Fab XENP20348, scFv XENP20385)

SEQ ID NO: 38035 - protein, 12 aa, Artificial Sequence
  Description of Artificial Sequence: Synthetic peptide
  [CTLA-4]_H3.4_L0.125  (Fab XENP20348, scFv XENP20385) vlCDR1
RASQSVSSSYLA

SEQ ID NO: 38036 - protein, 7 aa, Artificial Sequence
  Description of Artificial Sequence: Synthetic peptide
  [CTLA-4]_H3.4_L0.125  (Fab XENP20348, scFv XENP20385) vlCDR2
GAFSRAT

SEQ ID NO: 38037 - protein, 9 aa, Artificial Sequence
  Description of Artificial Sequence: Synthetic peptide
  [CTLA-4]_H3.4_L0.125  (Fab XENP20348, scFv XENP20385) vlCDR3
QQYGSSPWT

SEQ ID NO: 38038 - protein, 246 aa, Artificial Sequence; identical to SEQ ID NO: 2730
  Description of Artificial Sequence: Synthetic polypeptide
  scFV of [CTLA-4]_H3.4_L0.125  (Fab XENP20348, scFv XENP20385)

SEQ ID NO: 38039 - protein, 118 aa, Artificial Sequence; identical to SEQ ID NO: 2461
  Description of Artificial Sequence: Synthetic polypeptide
  VH of [CTLA-4]_H3.4_L0.126  (Fab XENP20349, scFv XENP20386)

SEQ ID NO: 38040 - protein, 5 aa, Artificial Sequence
  Description of Artificial Sequence: Synthetic peptide
  [CTLA-4]_H3.4_L0.126  (Fab XENP20349, scFv XENP20386) vhCDR1
SYTMH

SEQ ID NO: 38041 - protein, 17 aa, Artificial Sequence
  Description of Artificial Sequence: Synthetic peptide
  [CTLA-4]_H3.4_L0.126  (Fab XENP20349, scFv XENP20386) vhCDR2
FISYDGNHKYYADSVKG

SEQ ID NO: 38042 - protein, 9 aa, Artificial Sequence
  Description of Artificial Sequence: Synthetic peptide
  [CTLA-4]_H3.4_L0.126  (Fab XENP20349, scFv XENP20386) vhCDR3
TGHLGPFDL

SEQ ID NO: 38043 - protein, 108 aa, Artificial Sequence; identical to SEQ ID NO: 2066
  Description of Artificial Sequence: Synthetic polypeptide
  VL of [CTLA-4]_H3.4_L0.126  (Fab XENP20349, scFv XENP20386)

SEQ ID NO: 38044 - protein, 12 aa, Artificial Sequence
  Description of Artificial Sequence: Synthetic peptide
  [CTLA-4]_H3.4_L0.126  (Fab XENP20349, scFv XENP20386) vlCDR1
RASQSVGSSYLA

SEQ ID NO: 38045 - protein, 7 aa, Artificial Sequence
  Description of Artificial Sequence: Synthetic peptide
  [CTLA-4]_H3.4_L0.126  (Fab XENP20349, scFv XENP20386) vlCDR2
GASSRAT

SEQ ID NO: 38046 - protein, 9 aa, Artificial Sequence
  Description of Artificial Sequence: Synthetic peptide
  [CTLA-4]_H3.4_L0.126  (Fab XENP20349, scFv XENP20386) vlCDR3
QQYGSSPWT

SEQ ID NO: 38047 - protein, 246 aa, Artificial Sequence; identical to SEQ ID NO: 2739
  Description of Artificial Sequence: Synthetic polypeptide
  scFV of [CTLA-4]_H3.4_L0.126  (Fab XENP20349, scFv XENP20386)

SEQ ID NO: 38048 - protein, 118 aa, Artificial Sequence; identical to SEQ ID NO: 2461
  Description of Artificial Sequence: Synthetic polypeptide
  VH of [CTLA-4]_H3.4_L0.127  (Fab XENP20350, scFv XENP20387)

SEQ ID NO: 38049 - protein, 5 aa, Artificial Sequence
  Description of Artificial Sequence: Synthetic peptide
  [CTLA-4]_H3.4_L0.127  (Fab XENP20350, scFv XENP20387) vhCDR1
SYTMH

SEQ ID NO: 38050 - protein, 17 aa, Artificial Sequence
  Description of Artificial Sequence: Synthetic peptide
  [CTLA-4]_H3.4_L0.127  (Fab XENP20350, scFv XENP20387) vhCDR2
FISYDGNHKYYADSVKG

SEQ ID NO: 38051 - protein, 9 aa, Artificial Sequence
  Description of Artificial Sequence: Synthetic peptide
  [CTLA-4]_H3.4_L0.127  (Fab XENP20350, scFv XENP20387) vhCDR3
TGHLGPFDL

SEQ ID NO: 38052 - protein, 108 aa, Artificial Sequence; identical to SEQ ID NO: 2750
  Description of Artificial Sequence: Synthetic polypeptide
  VL of [CTLA-4]_H3.4_L0.127  (Fab XENP20350, scFv XENP20387)

SEQ ID NO: 38053 - protein, 12 aa, Artificial Sequence
  Description of Artificial Sequence: Synthetic peptide
  [CTLA-4]_H3.4_L0.127  (Fab XENP20350, scFv XENP20387) vlCDR1
RASQSVSSSYLA

SEQ ID NO: 38054 - protein, 7 aa, Artificial Sequence
  Description of Artificial Sequence: Synthetic peptide
  [CTLA-4]_H3.4_L0.127  (Fab XENP20350, scFv XENP20387) vlCDR2
GASSRAT

SEQ ID NO: 38055 - protein, 9 aa, Artificial Sequence
  Description of Artificial Sequence: Synthetic peptide
  [CTLA-4]_H3.4_L0.127  (Fab XENP20350, scFv XENP20387) vlCDR3
QQYGSSPWT

SEQ ID NO: 38056 - protein, 246 aa, Artificial Sequence; identical to SEQ ID NO: 2748
  Description of Artificial Sequence: Synthetic polypeptide
  scFV of [CTLA-4]_H3.4_L0.127  (Fab XENP20350, scFv XENP20387)

SEQ ID NO: 38057 - protein, 118 aa, Artificial Sequence; identical to SEQ ID NO: 2461
  Description of Artificial Sequence: Synthetic polypeptide
  VH of [CTLA-4]_H3.4_L0.128  (Fab XENP20351, scFv XENP20388)

SEQ ID NO: 38058 - protein, 5 aa, Artificial Sequence
  Description of Artificial Sequence: Synthetic peptide
  [CTLA-4]_H3.4_L0.128  (Fab XENP20351, scFv XENP20388) vhCDR1
SYTMH

SEQ ID NO: 38059 - protein, 17 aa, Artificial Sequence
  Description of Artificial Sequence: Synthetic peptide
  [CTLA-4]_H3.4_L0.128  (Fab XENP20351, scFv XENP20388) vhCDR2
FISYDGNHKYYADSVKG

SEQ ID NO: 38060 - protein, 9 aa, Artificial Sequence
  Description of Artificial Sequence: Synthetic peptide
  [CTLA-4]_H3.4_L0.128  (Fab XENP20351, scFv XENP20388) vhCDR3
TGHLGPFDL

SEQ ID NO: 38061 - protein, 108 aa, Artificial Sequence; identical to SEQ ID NO: 2759
  Description of Artificial Sequence: Synthetic polypeptide
  VL of [CTLA-4]_H3.4_L0.128  (Fab XENP20351, scFv XENP20388)

SEQ ID NO: 38062 - protein, 12 aa, Artificial Sequence
  Description of Artificial Sequence: Synthetic peptide
  [CTLA-4]_H3.4_L0.128  (Fab XENP20351, scFv XENP20388) vlCDR1
RASQSVSSSYLA

SEQ ID NO: 38063 - protein, 7 aa, Artificial Sequence
  Description of Artificial Sequence: Synthetic peptide
  [CTLA-4]_H3.4_L0.128  (Fab XENP20351, scFv XENP20388) vlCDR2
GAFSRAT

SEQ ID NO: 38064 - protein, 9 aa, Artificial Sequence
  Description of Artificial Sequence: Synthetic peptide
  [CTLA-4]_H3.4_L0.128  (Fab XENP20351, scFv XENP20388) vlCDR3
QQYGSSPWT

SEQ ID NO: 38065 - protein, 246 aa, Artificial Sequence; identical to SEQ ID NO: 2757
  Description of Artificial Sequence: Synthetic polypeptide
  scFV of [CTLA-4]_H3.4_L0.128  (Fab XENP20351, scFv XENP20388)

SEQ ID NO: 38066 - protein, 118 aa, Artificial Sequence; identical to SEQ ID NO: 2461
  Description of Artificial Sequence: Synthetic polypeptide
  VL of [CTLA-4]_H3.4_l0.129  (Fab XENP20352, scFv XENP20389)

SEQ ID NO: 38067 - protein, 5 aa, Artificial Sequence
  Description of Artificial Sequence: Synthetic peptide
  [CTLA-4]_H3.4_l0.129  (Fab XENP20352, scFv XENP20389) vlCDR1
SYTMH

SEQ ID NO: 38068 - protein, 17 aa, Artificial Sequence
  Description of Artificial Sequence: Synthetic peptide
  [CTLA-4]_H3.4_l0.129  (Fab XENP20352, scFv XENP20389) vlCDR2
FISYDGNHKYYADSVKG

SEQ ID NO: 38069 - protein, 9 aa, Artificial Sequence
  Description of Artificial Sequence: Synthetic peptide
  [CTLA-4]_H3.4_l0.129  (Fab XENP20352, scFv XENP20389) vlCDR3
TGHLGPFDL

SEQ ID NO: 38070 - protein, 246 aa, Artificial Sequence; identical to SEQ ID NO: 2766
  Description of Artificial Sequence: Synthetic polypeptide
  scFV of [CTLA-4]_H3.4_l0.129  (Fab XENP20352, scFv XENP20389)

SEQ ID NO: 38071 - protein, 118 aa, Artificial Sequence; identical to SEQ ID NO: 2461
  Description of Artificial Sequence: Synthetic polypeptide
  VH of [CTLA-4]_H3.4_L0.130 (Fab XENP20353, scFv XENP20390)

SEQ ID NO: 38072 - protein, 5 aa, Artificial Sequence
  Description of Artificial Sequence: Synthetic peptide
  [CTLA-4]_H3.4_L0.130 (Fab XENP20353, scFv XENP20390) vhCDR1
SYTMH

SEQ ID NO: 38073 - protein, 17 aa, Artificial Sequence
  Description of Artificial Sequence: Synthetic peptide
  [CTLA-4]_H3.4_L0.130 (Fab XENP20353, scFv XENP20390) vhCDR2
FISYDGNHKYYADSVKG

SEQ ID NO: 38074 - protein, 9 aa, Artificial Sequence
  Description of Artificial Sequence: Synthetic peptide
  [CTLA-4]_H3.4_L0.130 (Fab XENP20353, scFv XENP20390) vhCDR3
TGHLGPFDL

SEQ ID NO: 38075 - protein, 108 aa, Artificial Sequence; identical to SEQ ID NO: 2777
  Description of Artificial Sequence: Synthetic polypeptide
  VL of [CTLA-4]_H3.4_L0.130 (Fab XENP20353, scFv XENP20390)

SEQ ID NO: 38076 - protein, 12 aa, Artificial Sequence
  Description of Artificial Sequence: Synthetic peptide
  [CTLA-4]_H3.4_L0.130 (Fab XENP20353, scFv XENP20390) vlCDR1
RASQSVSSSYLA

SEQ ID NO: 38077 - protein, 7 aa, Artificial Sequence
  Description of Artificial Sequence: Synthetic peptide
  [CTLA-4]_H3.4_L0.130 (Fab XENP20353, scFv XENP20390) vlCDR2
GASSRAT

SEQ ID NO: 38078 - protein, 9 aa, Artificial Sequence
  Description of Artificial Sequence: Synthetic peptide
  [CTLA-4]_H3.4_L0.130 (Fab XENP20353, scFv XENP20390) vlCDR3
QQYGSSPWT

SEQ ID NO: 38079 - protein, 246 aa, Artificial Sequence; identical to SEQ ID NO: 2775
  Description of Artificial Sequence: Synthetic polypeptide
  scFV of [CTLA-4]_H3.4_L0.130 (Fab XENP20353, scFv XENP20390)

SEQ ID NO: 38080 - protein, 118 aa, Artificial Sequence; identical to SEQ ID NO: 2461
  Description of Artificial Sequence: Synthetic polypeptide
  VH of [CTLA-4]_H3.4_L0.131 (Fab XENP20354, scFv XENP20391)

SEQ ID NO: 38081 - protein, 5 aa, Artificial Sequence
  Description of Artificial Sequence: Synthetic peptide
  [CTLA-4]_H3.4_L0.131 (Fab XENP20354, scFv XENP20391) vhCDR1
SYTMH

SEQ ID NO: 38082 - protein, 17 aa, Artificial Sequence
  Description of Artificial Sequence: Synthetic peptide
  [CTLA-4]_H3.4_L0.131 (Fab XENP20354, scFv XENP20391) vhCDR2
FISYDGNHKYYADSVKG

SEQ ID NO: 38083 - protein, 9 aa, Artificial Sequence
  Description of Artificial Sequence: Synthetic peptide
  [CTLA-4]_H3.4_L0.131 (Fab XENP20354, scFv XENP20391) vhCDR3
TGHLGPFDL

SEQ ID NO: 38084 - protein, 108 aa, Artificial Sequence; identical to SEQ ID NO: 2786
  Description of Artificial Sequence: Synthetic polypeptide
  VL of [CTLA-4]_H3.4_L0.131 (Fab XENP20354, scFv XENP20391)

SEQ ID NO: 38085 - protein, 12 aa, Artificial Sequence
  Description of Artificial Sequence: Synthetic peptide
  [CTLA-4]_H3.4_L0.131 (Fab XENP20354, scFv XENP20391) vlCDR1
RASQSVSSSYLA

SEQ ID NO: 38086 - protein, 7 aa, Artificial Sequence
  Description of Artificial Sequence: Synthetic peptide
  [CTLA-4]_H3.4_L0.131 (Fab XENP20354, scFv XENP20391) vlCDR2
GASSRAT

SEQ ID NO: 38087 - protein, 9 aa, Artificial Sequence
  Description of Artificial Sequence: Synthetic peptide
  [CTLA-4]_H3.4_L0.131 (Fab XENP20354, scFv XENP20391) vlCDR3
QQYGSSPWT

SEQ ID NO: 38088 - protein, 246 aa, Artificial Sequence; identical to SEQ ID NO: 2784
  Description of Artificial Sequence: Synthetic polypeptide
  scFV of [CTLA-4]_H3.4_L0.131 (Fab XENP20354, scFv XENP20391)

SEQ ID NO: 38089 - protein, 118 aa, Artificial Sequence; identical to SEQ ID NO: 2461
  Description of Artificial Sequence: Synthetic polypeptide
  VH of [CTLA-4]_H3.4_L0.132  (Fab XENP20355, scFv XENP20392)

SEQ ID NO: 38090 - protein, 5 aa, Artificial Sequence
  Description of Artificial Sequence: Synthetic peptide
  [CTLA-4]_H3.4_L0.132  (Fab XENP20355, scFv XENP20392) vhCDR1
SYTMH

SEQ ID NO: 38091 - protein, 17 aa, Artificial Sequence
  Description of Artificial Sequence: Synthetic peptide
  [CTLA-4]_H3.4_L0.132  (Fab XENP20355, scFv XENP20392) vhCDR2
FISYDGNHKYYADSVKG

SEQ ID NO: 38092 - protein, 9 aa, Artificial Sequence
  Description of Artificial Sequence: Synthetic peptide
  [CTLA-4]_H3.4_L0.132  (Fab XENP20355, scFv XENP20392) vhCDR3
TGHLGPFDL

SEQ ID NO: 38093 - protein, 108 aa, Artificial Sequence; identical to SEQ ID NO: 2795
  Description of Artificial Sequence: Synthetic polypeptide
  VL of [CTLA-4]_H3.4_L0.132  (Fab XENP20355, scFv XENP20392)

SEQ ID NO: 38094 - protein, 12 aa, Artificial Sequence
  Description of Artificial Sequence: Synthetic peptide
  [CTLA-4]_H3.4_L0.132  (Fab XENP20355, scFv XENP20392) vlCDR1
RASQSVSSSYLA

SEQ ID NO: 38095 - protein, 7 aa, Artificial Sequence
  Description of Artificial Sequence: Synthetic peptide
  [CTLA-4]_H3.4_L0.132  (Fab XENP20355, scFv XENP20392) vlCDR2
GASSRAT

SEQ ID NO: 38096 - protein, 9 aa, Artificial Sequence
  Description of Artificial Sequence: Synthetic peptide
  [CTLA-4]_H3.4_L0.132  (Fab XENP20355, scFv XENP20392) vlCDR3
QQYGSSPWT

SEQ ID NO: 38097 - protein, 246 aa, Artificial Sequence; identical to SEQ ID NO: 2793
  Description of Artificial Sequence: Synthetic polypeptide
  scFV of [CTLA-4]_H3.4_L0.132  (Fab XENP20355, scFv XENP20392)

SEQ ID NO: 38098 - protein, 118 aa, Artificial Sequence; identical to SEQ ID NO: 2470
  Description of Artificial Sequence: Synthetic polypeptide
  VH of [CTLA-4]_H3.5_L2.1  (Fab XENP20357, scFv XENP20394)

SEQ ID NO: 38099 - protein, 5 aa, Artificial Sequence
  Description of Artificial Sequence: Synthetic peptide
  [CTLA-4]_H3.5_L2.1  (Fab XENP20357, scFv XENP20394) vhCDR1
SYTMH

SEQ ID NO: 38100 - protein, 17 aa, Artificial Sequence
  Description of Artificial Sequence: Synthetic peptide
  [CTLA-4]_H3.5_L2.1  (Fab XENP20357, scFv XENP20394) vhCDR2
FISYDGNTKYYADSVKG

SEQ ID NO: 38101 - protein, 9 aa, Artificial Sequence
  Description of Artificial Sequence: Synthetic peptide
  [CTLA-4]_H3.5_L2.1  (Fab XENP20357, scFv XENP20394) vhCDR3
TGHLGPFDL

SEQ ID NO: 38102 - protein, 108 aa, Artificial Sequence; identical to SEQ ID NO: 2813
  Description of Artificial Sequence: Synthetic polypeptide
  VL of [CTLA-4]_H3.5_L2.1  (Fab XENP20357, scFv XENP20394)

SEQ ID NO: 38103 - protein, 12 aa, Artificial Sequence
  Description of Artificial Sequence: Synthetic peptide
  [CTLA-4]_H3.5_L2.1  (Fab XENP20357, scFv XENP20394) vlCDR1
RASQSVSSSYLA

SEQ ID NO: 38104 - protein, 7 aa, Artificial Sequence
  Description of Artificial Sequence: Synthetic peptide
  [CTLA-4]_H3.5_L2.1  (Fab XENP20357, scFv XENP20394) vlCDR2
GAFSRAT

SEQ ID NO: 38105 - protein, 9 aa, Artificial Sequence
  Description of Artificial Sequence: Synthetic peptide
  [CTLA-4]_H3.5_L2.1  (Fab XENP20357, scFv XENP20394) vlCDR3
QQYGSSPWT

SEQ ID NO: 38106 - protein, 246 aa, Artificial Sequence; identical to SEQ ID NO: 2811
  Description of Artificial Sequence: Synthetic polypeptide
  scFV of [CTLA-4]_H3.5_L2.1  (Fab XENP20357, scFv XENP20394)

SEQ ID NO: 38107 - protein, 118 aa, Artificial Sequence; identical to SEQ ID NO: 2470
  Description of Artificial Sequence: Synthetic polypeptide
  VH of [CTLA-4]_H3.5_L2.2  (Fab XENP20358, scFv XENP20395)

SEQ ID NO: 38108 - protein, 5 aa, Artificial Sequence
  Description of Artificial Sequence: Synthetic peptide
  [CTLA-4]_H3.5_L2.2  (Fab XENP20358, scFv XENP20395) vhCDR1
SYTMH

SEQ ID NO: 38109 - protein, 17 aa, Artificial Sequence
  Description of Artificial Sequence: Synthetic peptide
  [CTLA-4]_H3.5_L2.2  (Fab XENP20358, scFv XENP20395) vhCDR2
FISYDGNTKYYADSVKG

SEQ ID NO: 38110 - protein, 9 aa, Artificial Sequence
  Description of Artificial Sequence: Synthetic peptide
  [CTLA-4]_H3.5_L2.2  (Fab XENP20358, scFv XENP20395) vhCDR3
TGHLGPFDL

SEQ ID NO: 38111 - protein, 108 aa, Artificial Sequence; identical to SEQ ID NO: 2822
  Description of Artificial Sequence: Synthetic polypeptide
  VL of [CTLA-4]_H3.5_L2.2  (Fab XENP20358, scFv XENP20395)

SEQ ID NO: 38112 - protein, 12 aa, Artificial Sequence
  Description of Artificial Sequence: Synthetic peptide
  [CTLA-4]_H3.5_L2.2  (Fab XENP20358, scFv XENP20395) vlCDR1
RASQSVGSSYLA

SEQ ID NO: 38113 - protein, 7 aa, Artificial Sequence
  Description of Artificial Sequence: Synthetic peptide
  [CTLA-4]_H3.5_L2.2  (Fab XENP20358, scFv XENP20395) vlCDR2
GASSRAT

SEQ ID NO: 38114 - protein, 9 aa, Artificial Sequence
  Description of Artificial Sequence: Synthetic peptide
  [CTLA-4]_H3.5_L2.2  (Fab XENP20358, scFv XENP20395) vlCDR3
QQYGSSPWT

SEQ ID NO: 38115 - protein, 246 aa, Artificial Sequence; identical to SEQ ID NO: 2820
  Description of Artificial Sequence: Synthetic polypeptide
  scFV of [CTLA-4]_H3.5_L2.2  (Fab XENP20358, scFv XENP20395)

SEQ ID NO: 38116 - protein, 118 aa, Artificial Sequence; identical to SEQ ID NO: 2470
  Description of Artificial Sequence: Synthetic polypeptide
  VH of [CTLA-4]_H3.5_L2.3  (Fab XENP20359, scFv XENP20396)

SEQ ID NO: 38117 - protein, 5 aa, Artificial Sequence
  Description of Artificial Sequence: Synthetic peptide
  [CTLA-4]_H3.5_L2.3  (Fab XENP20359, scFv XENP20396) vhCDR1
SYTMH

SEQ ID NO: 38118 - protein, 17 aa, Artificial Sequence
  Description of Artificial Sequence: Synthetic peptide
  [CTLA-4]_H3.5_L2.3  (Fab XENP20359, scFv XENP20396) vhCDR2
FISYDGNTKYYADSVKG

SEQ ID NO: 38119 - protein, 9 aa, Artificial Sequence
  Description of Artificial Sequence: Synthetic peptide
  [CTLA-4]_H3.5_L2.3  (Fab XENP20359, scFv XENP20396) vhCDR3
TGHLGPFDL

SEQ ID NO: 38120 - protein, 108 aa, Artificial Sequence; identical to SEQ ID NO: 2831
  Description of Artificial Sequence: Synthetic polypeptide
  VL of [CTLA-4]_H3.5_L2.3  (Fab XENP20359, scFv XENP20396)

SEQ ID NO: 38121 - protein, 12 aa, Artificial Sequence
  Description of Artificial Sequence: Synthetic peptide
  [CTLA-4]_H3.5_L2.3  (Fab XENP20359, scFv XENP20396) vlCDR1
RASQSVSSSYLA

SEQ ID NO: 38122 - protein, 7 aa, Artificial Sequence
  Description of Artificial Sequence: Synthetic peptide
  [CTLA-4]_H3.5_L2.3  (Fab XENP20359, scFv XENP20396) vlCDR2
GASSRAT

SEQ ID NO: 38123 - protein, 9 aa, Artificial Sequence
  Description of Artificial Sequence: Synthetic peptide
  [CTLA-4]_H3.5_L2.3  (Fab XENP20359, scFv XENP20396) vlCDR3
QQYGSSPWT

SEQ ID NO: 38124 - protein, 246 aa, Artificial Sequence; identical to SEQ ID NO: 2829
  Description of Artificial Sequence: Synthetic polypeptide
  scFV of [CTLA-4]_H3.5_L2.3  (Fab XENP20359, scFv XENP20396)

SEQ ID NO: 38125 - protein, 118 aa, Artificial Sequence; identical to SEQ ID NO: 139
  Description of Artificial Sequence: Synthetic polypeptide
  VH of [CTLA-4]_H3_L0  (Fab XENP19546, scFv XENP19553)

SEQ ID NO: 38126 - protein, 5 aa, Artificial Sequence
  Description of Artificial Sequence: Synthetic peptide
  [CTLA-4]_H3_L0  (Fab XENP19546, scFv XENP19553) vhCDR1
SYTMH

SEQ ID NO: 38127 - protein, 17 aa, Artificial Sequence
  Description of Artificial Sequence: Synthetic peptide
  [CTLA-4]_H3_L0  (Fab XENP19546, scFv XENP19553) vhCDR2
FISYDGNNKYYADSVKG

SEQ ID NO: 38128 - protein, 9 aa, Artificial Sequence
  Description of Artificial Sequence: Synthetic peptide
  [CTLA-4]_H3_L0  (Fab XENP19546, scFv XENP19553) vhCDR3
TGWLGPFDY

SEQ ID NO: 38129 - protein, 108 aa, Artificial Sequence; identical to SEQ ID NO: 23
  Description of Artificial Sequence: Synthetic polypeptide
  VL of [CTLA-4]_H3_L0  (Fab XENP19546, scFv XENP19553)

SEQ ID NO: 38130 - protein, 12 aa, Artificial Sequence
  Description of Artificial Sequence: Synthetic peptide
  [CTLA-4]_H3_L0  (Fab XENP19546, scFv XENP19553) vlCDR1
RASQSVGSSYLA

SEQ ID NO: 38131 - protein, 7 aa, Artificial Sequence
  Description of Artificial Sequence: Synthetic peptide
  [CTLA-4]_H3_L0  (Fab XENP19546, scFv XENP19553) vlCDR2
GAFSRAT

SEQ ID NO: 38132 - protein, 9 aa, Artificial Sequence
  Description of Artificial Sequence: Synthetic peptide
  [CTLA-4]_H3_L0  (Fab XENP19546, scFv XENP19553) vlCDR3
QQYGSSPWT

SEQ ID NO: 38133 - protein, 246 aa, Artificial Sequence; identical to SEQ ID NO: 138
  Description of Artificial Sequence: Synthetic polypeptide
  scFV of [CTLA-4]_H3_L0  (Fab XENP19546, scFv XENP19553)

SEQ ID NO: 38134 - protein, 118 aa, Artificial Sequence; identical to SEQ ID NO: 139
  Description of Artificial Sequence: Synthetic polypeptide
  VH of [CTLA-4]_H3_L0.22  (Fab XENP20011)

SEQ ID NO: 38135 - protein, 5 aa, Artificial Sequence
  Description of Artificial Sequence: Synthetic peptide
  [CTLA-4]_H3_L0.22  (Fab XENP20011) vhCDR1
SYTMH

SEQ ID NO: 38136 - protein, 17 aa, Artificial Sequence
  Description of Artificial Sequence: Synthetic peptide
  [CTLA-4]_H3_L0.22  (Fab XENP20011) vhCDR2
FISYDGNNKYYADSVKG

SEQ ID NO: 38137 - protein, 9 aa, Artificial Sequence
  Description of Artificial Sequence: Synthetic peptide
  [CTLA-4]_H3_L0.22  (Fab XENP20011) vhCDR3
TGWLGPFDY

SEQ ID NO: 38138 - protein, 108 aa, Artificial Sequence; identical to SEQ ID NO: 1607
  Description of Artificial Sequence: Synthetic polypeptide
  VL of [CTLA-4]_H3_L0.22  (Fab XENP20011)

SEQ ID NO: 38139 - protein, 12 aa, Artificial Sequence
  Description of Artificial Sequence: Synthetic peptide
  [CTLA-4]_H3_L0.22  (Fab XENP20011) vlCDR1
RASQSVSSSYLA

SEQ ID NO: 38140 - protein, 7 aa, Artificial Sequence
  Description of Artificial Sequence: Synthetic peptide
  [CTLA-4]_H3_L0.22  (Fab XENP20011) vlCDR2
GAFSRAT

SEQ ID NO: 38141 - protein, 9 aa, Artificial Sequence
  Description of Artificial Sequence: Synthetic peptide
  [CTLA-4]_H3_L0.22  (Fab XENP20011) vlCDR3
QQYGSSPWT

SEQ ID NO: 38142 - protein, 246 aa, Artificial Sequence
  Description of Artificial Sequence: Synthetic polypeptide
  scFV of [CTLA-4]_H3_L0.22  (Fab XENP20011)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 38143 - protein, 118 aa, Artificial Sequence; identical to SEQ ID NO: 139
  Description of Artificial Sequence: Synthetic polypeptide
  VH of [CTLA-4]_H3_L0.44  (Fab XENP20052)

SEQ ID NO: 38144 - protein, 5 aa, Artificial Sequence
  Description of Artificial Sequence: Synthetic peptide
  [CTLA-4]_H3_L0.44  (Fab XENP20052) vhCDR1
SYTMH

SEQ ID NO: 38145 - protein, 17 aa, Artificial Sequence
  Description of Artificial Sequence: Synthetic peptide
  [CTLA-4]_H3_L0.44  (Fab XENP20052) vhCDR2
FISYDGNNKYYADSVKG

SEQ ID NO: 38146 - protein, 9 aa, Artificial Sequence
  Description of Artificial Sequence: Synthetic peptide
  [CTLA-4]_H3_L0.44  (Fab XENP20052) vhCDR3
TGWLGPFDY

SEQ ID NO: 38147 - protein, 108 aa, Artificial Sequence; identical to SEQ ID NO: 1805
  Description of Artificial Sequence: Synthetic polypeptide
  VL of [CTLA-4]_H3_L0.44  (Fab XENP20052)

SEQ ID NO: 38148 - protein, 12 aa, Artificial Sequence
  Description of Artificial Sequence: Synthetic peptide
  [CTLA-4]_H3_L0.44  (Fab XENP20052) vlCDR1
RASQSVGSSYLS

SEQ ID NO: 38149 - protein, 7 aa, Artificial Sequence
  Description of Artificial Sequence: Synthetic peptide
  [CTLA-4]_H3_L0.44  (Fab XENP20052) vlCDR2
GAFSRAT

SEQ ID NO: 38150 - protein, 9 aa, Artificial Sequence
  Description of Artificial Sequence: Synthetic peptide
  [CTLA-4]_H3_L0.44  (Fab XENP20052) vlCDR3
QQYGSSPWT

SEQ ID NO: 38151 - protein, 246 aa, Artificial Sequence
  Description of Artificial Sequence: Synthetic polypeptide
  scFV of [CTLA-4]_H3_L0.44  (Fab XENP20052)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 38152 - protein, 118 aa, Artificial Sequence; identical to SEQ ID NO: 139
  Description of Artificial Sequence: Synthetic polypeptide
  VH of [CTLA-4]_H3_L0.67  (Fab XENP20018)

SEQ ID NO: 38153 - protein, 5 aa, Artificial Sequence
  Description of Artificial Sequence: Synthetic peptide
  [CTLA-4]_H3_L0.67  (Fab XENP20018) vhCDR1
SYTMH

SEQ ID NO: 38154 - protein, 17 aa, Artificial Sequence
  Description of Artificial Sequence: Synthetic peptide
  [CTLA-4]_H3_L0.67  (Fab XENP20018) vhCDR2
FISYDGNNKYYADSVKG

SEQ ID NO: 38155 - protein, 9 aa, Artificial Sequence
  Description of Artificial Sequence: Synthetic peptide
  [CTLA-4]_H3_L0.67  (Fab XENP20018) vhCDR3
TGWLGPFDY

SEQ ID NO: 38156 - protein, 108 aa, Artificial Sequence; identical to SEQ ID NO: 2012
  Description of Artificial Sequence: Synthetic polypeptide
  VL of [CTLA-4]_H3_L0.67  (Fab XENP20018)

SEQ ID NO: 38157 - protein, 12 aa, Artificial Sequence
  Description of Artificial Sequence: Synthetic peptide
  [CTLA-4]_H3_L0.67  (Fab XENP20018) vlCDR1
RASQSVGSSYLA

SEQ ID NO: 38158 - protein, 7 aa, Artificial Sequence
  Description of Artificial Sequence: Synthetic peptide
  [CTLA-4]_H3_L0.67  (Fab XENP20018) vlCDR2
DAFSRAT

SEQ ID NO: 38159 - protein, 9 aa, Artificial Sequence
  Description of Artificial Sequence: Synthetic peptide
  [CTLA-4]_H3_L0.67  (Fab XENP20018) vlCDR3
QQYGSSPWT

SEQ ID NO: 38160 - protein, 246 aa, Artificial Sequence
  Description of Artificial Sequence: Synthetic polypeptide
  scFV of [CTLA-4]_H3_L0.67  (Fab XENP20018)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 38161 - protein, 118 aa, Artificial Sequence; identical to SEQ ID NO: 139
  Description of Artificial Sequence: Synthetic polypeptide
  VH of [CTLA-4]_H3_L0.74  (Fab XENP20020)

SEQ ID NO: 38162 - protein, 5 aa, Artificial Sequence
  Description of Artificial Sequence: Synthetic peptide
  [CTLA-4]_H3_L0.74  (Fab XENP20020) vhCDR1
SYTMH

SEQ ID NO: 38163 - protein, 17 aa, Artificial Sequence
  Description of Artificial Sequence: Synthetic peptide
  [CTLA-4]_H3_L0.74  (Fab XENP20020) vhCDR2
FISYDGNNKYYADSVKG

SEQ ID NO: 38164 - protein, 9 aa, Artificial Sequence
  Description of Artificial Sequence: Synthetic peptide
  [CTLA-4]_H3_L0.74  (Fab XENP20020) vhCDR3
TGWLGPFDY

SEQ ID NO: 38165 - protein, 108 aa, Artificial Sequence; identical to SEQ ID NO: 2075
  Description of Artificial Sequence: Synthetic polypeptide
  VL of [CTLA-4]_H3_L0.74  (Fab XENP20020)

SEQ ID NO: 38166 - protein, 12 aa, Artificial Sequence
  Description of Artificial Sequence: Synthetic peptide
  [CTLA-4]_H3_L0.74  (Fab XENP20020) vlCDR1
RASQSVGSSYLA

SEQ ID NO: 38167 - protein, 7 aa, Artificial Sequence
  Description of Artificial Sequence: Synthetic peptide
  [CTLA-4]_H3_L0.74  (Fab XENP20020) vlCDR2
GAYSRAT

SEQ ID NO: 38168 - protein, 9 aa, Artificial Sequence
  Description of Artificial Sequence: Synthetic peptide
  [CTLA-4]_H3_L0.74  (Fab XENP20020) vlCDR3
QQYGSSPWT

SEQ ID NO: 38169 - protein, 246 aa, Artificial Sequence
  Description of Artificial Sequence: Synthetic polypeptide
  scFV of [CTLA-4]_H3_L0.74  (Fab XENP20020)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 38170 - protein, 121 aa, Artificial Sequence; identical to SEQ ID NO: 22485
  Description of Artificial Sequence: Synthetic polypeptide
  VH of XENP22594

SEQ ID NO: 38171 - protein, 5 aa, Artificial Sequence
  Description of Artificial Sequence: Synthetic peptide
  XENP22594 vhCDR1
DAWMS

SEQ ID NO: 38172 - protein, 19 aa, Artificial Sequence
  Description of Artificial Sequence: Synthetic peptide
  XENP22594 vhCDR2
EISTKANNHATYYAESVKG

SEQ ID NO: 38173 - protein, 10 aa, Artificial Sequence
  Description of Artificial Sequence: Synthetic peptide
  XENP22594 vhCDR3
LATWDWYFDV

SEQ ID NO: 38174 - protein, 111 aa, Artificial Sequence; identical to SEQ ID NO: 22600
  Description of Artificial Sequence: Synthetic polypeptide
  VL of XENP22594

SEQ ID NO: 38175 - protein, 15 aa, Artificial Sequence
  Description of Artificial Sequence: Synthetic peptide
  XENP22594 vlCDR1
RASQSVDYDGDSYMN

SEQ ID NO: 38176 - protein, 7 aa, Artificial Sequence
  Description of Artificial Sequence: Synthetic peptide
  XENP22594 vlCDR2
AASELES

SEQ ID NO: 38177 - protein, 9 aa, Artificial Sequence
  Description of Artificial Sequence: Synthetic peptide
  XENP22594 vlCDR3
QQSNEDPFT

SEQ ID NO: 38178 - protein, 118 aa, Artificial Sequence; identical to SEQ ID NO: 22085
  Description of Artificial Sequence: Synthetic polypeptide
  VH of XENP22656

SEQ ID NO: 38179 - protein, 5 aa, Artificial Sequence
  Description of Artificial Sequence: Synthetic peptide
  XENP22656 vhCDR1
DYFMH

SEQ ID NO: 38180 - protein, 17 aa, Artificial Sequence
  Description of Artificial Sequence: Synthetic peptide
  XENP22656 vhCDR2
WIDPELGDTEYAPKFQG

SEQ ID NO: 38181 - protein, 9 aa, Artificial Sequence
  Description of Artificial Sequence: Synthetic peptide
  XENP22656 vhCDR3
RGVYQALDY

SEQ ID NO: 38182 - protein, 107 aa, Artificial Sequence; identical to SEQ ID NO: 22280
  Description of Artificial Sequence: Synthetic polypeptide
  VL of XENP22656

SEQ ID NO: 38183 - protein, 11 aa, Artificial Sequence
  Description of Artificial Sequence: Synthetic peptide
  XENP22656 vlCDR1
QASQDIGNYLN

SEQ ID NO: 38184 - protein, 7 aa, Artificial Sequence
  Description of Artificial Sequence: Synthetic peptide
  XENP22656 vlCDR2
FTSYLHS

SEQ ID NO: 38185 - protein, 9 aa, Artificial Sequence
  Description of Artificial Sequence: Synthetic peptide
  XENP22656 vlCDR3
QQGNTLPYT

SEQ ID NO: 38186 - protein, 121 aa, Artificial Sequence; identical to SEQ ID NO: 22325
  Description of Artificial Sequence: Synthetic polypeptide
  VH of XENP21670

SEQ ID NO: 38187 - protein, 5 aa, Artificial Sequence
  Description of Artificial Sequence: Synthetic peptide
  XENP21670 vhCDR1
DAWMD

SEQ ID NO: 38188 - protein, 19 aa, Artificial Sequence
  Description of Artificial Sequence: Synthetic peptide
  XENP21670 vhCDR2
EISTKANNHATYYAESVKG

SEQ ID NO: 38189 - protein, 10 aa, Artificial Sequence
  Description of Artificial Sequence: Synthetic peptide
  XENP21670 vhCDR3
LATWDWYFDV

SEQ ID NO: 38190 - protein, 111 aa, Artificial Sequence; identical to SEQ ID NO: 22360
  Description of Artificial Sequence: Synthetic polypeptide
  VL of XENP21670

SEQ ID NO: 38191 - protein, 15 aa, Artificial Sequence
  Description of Artificial Sequence: Synthetic peptide
  XENP21670 vlCDR1
RASQSVDYDGDSYMN

SEQ ID NO: 38192 - protein, 7 aa, Artificial Sequence
  Description of Artificial Sequence: Synthetic peptide
  XENP21670 vlCDR2
AASELES

SEQ ID NO: 38193 - protein, 9 aa, Artificial Sequence
  Description of Artificial Sequence: Synthetic peptide
  XENP21670 vlCDR3
QQSNEDPFT

SEQ ID NO: 38194 - protein, 121 aa, Artificial Sequence; identical to SEQ ID NO: 17586
  Description of Artificial Sequence: Synthetic polypeptide
  VH of XENP20930

SEQ ID NO: 38195 - protein, 5 aa, Artificial Sequence
  Description of Artificial Sequence: Synthetic peptide
  XENP20930 vhCDR1
DAWMD

SEQ ID NO: 38196 - protein, 19 aa, Artificial Sequence
  Description of Artificial Sequence: Synthetic peptide
  XENP20930 vhCDR2
EIRTKANNHATYYAESVKG

SEQ ID NO: 38197 - protein, 10 aa, Artificial Sequence
  Description of Artificial Sequence: Synthetic peptide
  XENP20930 vhCDR3
LANWDWYFDV

SEQ ID NO: 38198 - protein, 111 aa, Artificial Sequence; identical to SEQ ID NO: 17591
  Description of Artificial Sequence: Synthetic polypeptide
  VL of XENP20930

SEQ ID NO: 38199 - protein, 15 aa, Artificial Sequence
  Description of Artificial Sequence: Synthetic peptide
  XENP20930 vlCDR1
KASQSVDYDGDSYMN

SEQ ID NO: 38200 - protein, 7 aa, Artificial Sequence
  Description of Artificial Sequence: Synthetic peptide
  XENP20930 vlCDR2
AASNLES

SEQ ID NO: 38201 - protein, 9 aa, Artificial Sequence
  Description of Artificial Sequence: Synthetic peptide
  XENP20930 vlCDR3
QQSNEDPFT

SEQ ID NO: 38202 - protein, 118 aa, Artificial Sequence; identical to SEQ ID NO: 22065
  Description of Artificial Sequence: Synthetic polypeptide
  VH of XENP21921

SEQ ID NO: 38203 - protein, 5 aa, Artificial Sequence
  Description of Artificial Sequence: Synthetic peptide
  XENP21921 vhCDR1
HYFMH

SEQ ID NO: 38204 - protein, 17 aa, Artificial Sequence
  Description of Artificial Sequence: Synthetic peptide
  XENP21921 vhCDR2
WIDPYLGDTEYAPKFQG

SEQ ID NO: 38205 - protein, 9 aa, Artificial Sequence
  Description of Artificial Sequence: Synthetic peptide
  XENP21921 vhCDR3
RGVYQALDY

SEQ ID NO: 38206 - protein, 107 aa, Artificial Sequence; identical to SEQ ID NO: 22080
  Description of Artificial Sequence: Synthetic polypeptide
  VL of XENP21921

SEQ ID NO: 38207 - protein, 11 aa, Artificial Sequence
  Description of Artificial Sequence: Synthetic peptide
  XENP21921 vlCDR1
QASQDIGNYLN

SEQ ID NO: 38208 - protein, 7 aa, Artificial Sequence
  Description of Artificial Sequence: Synthetic peptide
  XENP21921 vlCDR2
FTSYLHS

SEQ ID NO: 38209 - protein, 9 aa, Artificial Sequence
  Description of Artificial Sequence: Synthetic peptide
  XENP21921 vlCDR3
QQGNTLPYT

SEQ ID NO: 38210 - protein, 118 aa, Artificial Sequence; identical to SEQ ID NO: 17236
  Description of Artificial Sequence: Synthetic polypeptide
  VH of XENP20847

SEQ ID NO: 38211 - protein, 5 aa, Artificial Sequence
  Description of Artificial Sequence: Synthetic peptide
  XENP20847 vhCDR1
DYYMH

SEQ ID NO: 38212 - protein, 17 aa, Artificial Sequence
  Description of Artificial Sequence: Synthetic peptide
  XENP20847 vhCDR2
WIDPENGDTEYAPKFQG

SEQ ID NO: 38213 - protein, 9 aa, Artificial Sequence
  Description of Artificial Sequence: Synthetic peptide
  XENP20847 vhCDR3
RGVRQALDY

SEQ ID NO: 38214 - protein, 107 aa, Artificial Sequence; identical to SEQ ID NO: 17251
  Description of Artificial Sequence: Synthetic polypeptide
  VL of XENP20847

SEQ ID NO: 38215 - protein, 11 aa, Artificial Sequence
  Description of Artificial Sequence: Synthetic peptide
  XENP20847 vlCDR1
QASQDIGNYLN

SEQ ID NO: 38216 - protein, 7 aa, Artificial Sequence
  Description of Artificial Sequence: Synthetic peptide
  XENP20847 vlCDR2
YTSRLHS

SEQ ID NO: 38217 - protein, 9 aa, Artificial Sequence
  Description of Artificial Sequence: Synthetic peptide
  XENP20847 vlCDR3
QQGNTLPYT

SEQ ID NO: 38218 - protein, 118 aa, Artificial Sequence; identical to SEQ ID NO: 17236
  Description of Artificial Sequence: Synthetic polypeptide
  VH of XENP21372

SEQ ID NO: 38219 - protein, 5 aa, Artificial Sequence
  Description of Artificial Sequence: Synthetic peptide
  XENP21372 vhCDR1
DYYMH

SEQ ID NO: 38220 - protein, 17 aa, Artificial Sequence
  Description of Artificial Sequence: Synthetic peptide
  XENP21372 vhCDR2
WIDPENGDTEYAPKFQG

SEQ ID NO: 38221 - protein, 9 aa, Artificial Sequence
  Description of Artificial Sequence: Synthetic peptide
  XENP21372 vhCDR3
RGVRQALDY

SEQ ID NO: 38222 - protein, 107 aa, Artificial Sequence; identical to SEQ ID NO: 22180
  Description of Artificial Sequence: Synthetic polypeptide
  VL of XENP21372

SEQ ID NO: 38223 - protein, 11 aa, Artificial Sequence
  Description of Artificial Sequence: Synthetic peptide
  XENP21372 vlCDR1
QASQDIGNHLN

SEQ ID NO: 38224 - protein, 7 aa, Artificial Sequence
  Description of Artificial Sequence: Synthetic peptide
  XENP21372 vlCDR2
YTSRLHS

SEQ ID NO: 38225 - protein, 9 aa, Artificial Sequence
  Description of Artificial Sequence: Synthetic peptide
  XENP21372 vlCDR3
QQGNTLPYT

SEQ ID NO: 38226 - protein, 118 aa, Artificial Sequence; identical to SEQ ID NO: 17236
  Description of Artificial Sequence: Synthetic polypeptide
  VH of XENP21394

SEQ ID NO: 38227 - protein, 5 aa, Artificial Sequence
  Description of Artificial Sequence: Synthetic peptide
  XENP21394 vhCDR1
DYYMH

SEQ ID NO: 38228 - protein, 17 aa, Artificial Sequence
  Description of Artificial Sequence: Synthetic peptide
  XENP21394 vhCDR2
WIDPENGDTEYAPKFQG

SEQ ID NO: 38229 - protein, 9 aa, Artificial Sequence
  Description of Artificial Sequence: Synthetic peptide
  XENP21394 vhCDR3
RGVRQALDY

SEQ ID NO: 38230 - protein, 107 aa, Artificial Sequence; identical to SEQ ID NO: 22040
  Description of Artificial Sequence: Synthetic polypeptide
  VL of XENP21394

SEQ ID NO: 38231 - protein, 11 aa, Artificial Sequence
  Description of Artificial Sequence: Synthetic peptide
  XENP21394 vlCDR1
QASQDIGNYLN

SEQ ID NO: 38232 - protein, 7 aa, Artificial Sequence
  Description of Artificial Sequence: Synthetic peptide
  XENP21394 vlCDR2
YTSHLHS

SEQ ID NO: 38233 - protein, 9 aa, Artificial Sequence
  Description of Artificial Sequence: Synthetic peptide
  XENP21394 vlCDR3
QQGNTLPYT

SEQ ID NO: 38234 - protein, 118 aa, Artificial Sequence; identical to SEQ ID NO: 17236
  Description of Artificial Sequence: Synthetic polypeptide
  VH of XENP21401

SEQ ID NO: 38235 - protein, 5 aa, Artificial Sequence
  Description of Artificial Sequence: Synthetic peptide
  XENP21401 vhCDR1
DYYMH

SEQ ID NO: 38236 - protein, 17 aa, Artificial Sequence
  Description of Artificial Sequence: Synthetic peptide
  XENP21401 vhCDR2
WIDPENGDTEYAPKFQG

SEQ ID NO: 38237 - protein, 9 aa, Artificial Sequence
  Description of Artificial Sequence: Synthetic peptide
  XENP21401 vhCDR3
RGVRQALDY

SEQ ID NO: 38238 - protein, 107 aa, Artificial Sequence; identical to SEQ ID NO: 22060
  Description of Artificial Sequence: Synthetic polypeptide
  VL of XENP21401

SEQ ID NO: 38239 - protein, 11 aa, Artificial Sequence
  Description of Artificial Sequence: Synthetic peptide
  XENP21401 vlCDR1
QASQDIGNYLN

SEQ ID NO: 38240 - protein, 7 aa, Artificial Sequence
  Description of Artificial Sequence: Synthetic peptide
  XENP21401 vlCDR2
YTSYLHS

SEQ ID NO: 38241 - protein, 9 aa, Artificial Sequence
  Description of Artificial Sequence: Synthetic peptide
  XENP21401 vlCDR3
QQGNTLPYT

SEQ ID NO: 38242 - protein, 118 aa, Artificial Sequence; identical to SEQ ID NO: 17236
  Description of Artificial Sequence: Synthetic polypeptide
  VH of XENP20847

SEQ ID NO: 38243 - protein, 5 aa, Artificial Sequence
  Description of Artificial Sequence: Synthetic peptide
  XENP20847 vhCDR1
DYYMH

SEQ ID NO: 38244 - protein, 17 aa, Artificial Sequence
  Description of Artificial Sequence: Synthetic peptide
  XENP20847 vhCDR2
WIDPENGDTEYAPKFQG

SEQ ID NO: 38245 - protein, 9 aa, Artificial Sequence
  Description of Artificial Sequence: Synthetic peptide
  XENP20847 vhCDR3
RGVRQALDY

SEQ ID NO: 38246 - protein, 107 aa, Artificial Sequence; identical to SEQ ID NO: 17251
  Description of Artificial Sequence: Synthetic polypeptide
  VL of XENP20847

SEQ ID NO: 38247 - protein, 11 aa, Artificial Sequence
  Description of Artificial Sequence: Synthetic peptide
  XENP20847 vlCDR1
QASQDIGNYLN

SEQ ID NO: 38248 - protein, 7 aa, Artificial Sequence
  Description of Artificial Sequence: Synthetic peptide
  XENP20847 vlCDR2
YTSRLHS

SEQ ID NO: 38249 - protein, 9 aa, Artificial Sequence
  Description of Artificial Sequence: Synthetic peptide
  XENP20847 vlCDR3
QQGNTLPYT

SEQ ID NO: 38250 - protein, 121 aa, Artificial Sequence; identical to SEQ ID NO: 22325
  Description of Artificial Sequence: Synthetic polypeptide
  VH of XENP21670

SEQ ID NO: 38251 - protein, 5 aa, Artificial Sequence
  Description of Artificial Sequence: Synthetic peptide
  XENP21670 vhCDR1
DAWMD

SEQ ID NO: 38252 - protein, 19 aa, Artificial Sequence
  Description of Artificial Sequence: Synthetic peptide
  XENP21670 vhCDR2
EISTKANNHATYYAESVKG

SEQ ID NO: 38253 - protein, 10 aa, Artificial Sequence
  Description of Artificial Sequence: Synthetic peptide
  XENP21670 vhCDR3
LATWDWYFDV

SEQ ID NO: 38254 - protein, 111 aa, Artificial Sequence; identical to SEQ ID NO: 22360
  Description of Artificial Sequence: Synthetic polypeptide
  VL of XENP21670

SEQ ID NO: 38255 - protein, 15 aa, Artificial Sequence
  Description of Artificial Sequence: Synthetic peptide
  XENP21670 vlCDR1
RASQSVDYDGDSYMN

SEQ ID NO: 38256 - protein, 7 aa, Artificial Sequence
  Description of Artificial Sequence: Synthetic peptide
  XENP21670 vlCDR2
AASELES

SEQ ID NO: 38257 - protein, 9 aa, Artificial Sequence
  Description of Artificial Sequence: Synthetic peptide
  XENP21670 vlCDR3
QQSNEDPFT

SEQ ID NO: 38258 - protein, 121 aa, Artificial Sequence; identical to SEQ ID NO: 22425
  Description of Artificial Sequence: Synthetic polypeptide
  VH of XENP21892

SEQ ID NO: 38259 - protein, 5 aa, Artificial Sequence
  Description of Artificial Sequence: Synthetic peptide
  XENP21892 vhCDR1
DAWMD

SEQ ID NO: 38260 - protein, 19 aa, Artificial Sequence
  Description of Artificial Sequence: Synthetic peptide
  XENP21892 vhCDR2
EISTKAYNHATYYAESVKG

SEQ ID NO: 38261 - protein, 10 aa, Artificial Sequence
  Description of Artificial Sequence: Synthetic peptide
  XENP21892 vhCDR3
LATWDWYFDV

SEQ ID NO: 38262 - protein, 111 aa, Artificial Sequence; identical to SEQ ID NO: 17601
  Description of Artificial Sequence: Synthetic polypeptide
  VL of XENP21892

SEQ ID NO: 38263 - protein, 15 aa, Artificial Sequence
  Description of Artificial Sequence: Synthetic peptide
  XENP21892 vlCDR1
RASQSVDYDGDSYMN

SEQ ID NO: 38264 - protein, 7 aa, Artificial Sequence
  Description of Artificial Sequence: Synthetic peptide
  XENP21892 vlCDR2
AASNLES

SEQ ID NO: 38265 - protein, 9 aa, Artificial Sequence
  Description of Artificial Sequence: Synthetic peptide
  XENP21892 vlCDR3
QQSNEDPFT

SEQ ID NO: 38266 - protein, 121 aa, Artificial Sequence; identical to SEQ ID NO: 22425
  Description of Artificial Sequence: Synthetic polypeptide
  VH of XENP21893

SEQ ID NO: 38267 - protein, 5 aa, Artificial Sequence
  Description of Artificial Sequence: Synthetic peptide
  XENP21893 vhCDR1
DAWMD

SEQ ID NO: 38268 - protein, 19 aa, Artificial Sequence
  Description of Artificial Sequence: Synthetic peptide
  XENP21893 vhCDR2
EISTKAYNHATYYAESVKG

SEQ ID NO: 38269 - protein, 10 aa, Artificial Sequence
  Description of Artificial Sequence: Synthetic peptide
  XENP21893 vhCDR3
LATWDWYFDV

SEQ ID NO: 38270 - protein, 111 aa, Artificial Sequence; identical to SEQ ID NO: 22360
  Description of Artificial Sequence: Synthetic polypeptide
  VL of XENP21893

SEQ ID NO: 38271 - protein, 15 aa, Artificial Sequence
  Description of Artificial Sequence: Synthetic peptide
  XENP21893 vlCDR1
RASQSVDYDGDSYMN

SEQ ID NO: 38272 - protein, 7 aa, Artificial Sequence
  Description of Artificial Sequence: Synthetic peptide
  XENP21893 vlCDR2
AASELES

SEQ ID NO: 38273 - protein, 9 aa, Artificial Sequence
  Description of Artificial Sequence: Synthetic peptide
  XENP21893 vlCDR3
QQSNEDPFT

SEQ ID NO: 38274 - protein, 121 aa, Artificial Sequence; identical to SEQ ID NO: 22425
  Description of Artificial Sequence: Synthetic polypeptide
  VH of XENP21894

SEQ ID NO: 38275 - protein, 5 aa, Artificial Sequence
  Description of Artificial Sequence: Synthetic peptide
  XENP21894 vhCDR1
DAWMD

SEQ ID NO: 38276 - protein, 19 aa, Artificial Sequence
  Description of Artificial Sequence: Synthetic peptide
  XENP21894 vhCDR2
EISTKAYNHATYYAESVKG

SEQ ID NO: 38277 - protein, 10 aa, Artificial Sequence
  Description of Artificial Sequence: Synthetic peptide
  XENP21894 vhCDR3
LATWDWYFDV

SEQ ID NO: 38278 - protein, 111 aa, Artificial Sequence; identical to SEQ ID NO: 22420
  Description of Artificial Sequence: Synthetic polypeptide
  VL of XENP21894

SEQ ID NO: 38279 - protein, 15 aa, Artificial Sequence
  Description of Artificial Sequence: Synthetic peptide
  XENP21894 vlCDR1
RASQSVDHDGDSYMN

SEQ ID NO: 38280 - protein, 7 aa, Artificial Sequence
  Description of Artificial Sequence: Synthetic peptide
  XENP21894 vlCDR2
AASELES

SEQ ID NO: 38281 - protein, 9 aa, Artificial Sequence
  Description of Artificial Sequence: Synthetic peptide
  XENP21894 vlCDR3
QQSNEDPFT

SEQ ID NO: 38282 - protein, 118 aa, Artificial Sequence; identical to SEQ ID NO: 20936
  Description of Artificial Sequence: Synthetic polypeptide
  VH of XENP20269

SEQ ID NO: 38283 - protein, 5 aa, Artificial Sequence
  Description of Artificial Sequence: Synthetic peptide
  XENP20269 vhCDR1
GYGVN

SEQ ID NO: 38284 - protein, 16 aa, Artificial Sequence
  Description of Artificial Sequence: Synthetic peptide
  XENP20269 vhCDR2
MIWIDGSTDYNSALKS

SEQ ID NO: 38285 - protein, 10 aa, Artificial Sequence
  Description of Artificial Sequence: Synthetic peptide
  XENP20269 vhCDR3
DRPDGRAMDY

SEQ ID NO: 38286 - protein, 106 aa, Artificial Sequence; identical to SEQ ID NO: 20941
  Description of Artificial Sequence: Synthetic polypeptide
  VL of XENP20269

SEQ ID NO: 38287 - protein, 11 aa, Artificial Sequence
  Description of Artificial Sequence: Synthetic peptide
  XENP20269 vlCDR1
KASQSVSNDVA

SEQ ID NO: 38288 - protein, 7 aa, Artificial Sequence
  Description of Artificial Sequence: Synthetic peptide
  XENP20269 vlCDR2
YASNRYT

SEQ ID NO: 38289 - protein, 8 aa, Artificial Sequence
  Description of Artificial Sequence: Synthetic peptide
  XENP20269 vlCDR3
QQDYSSPT

SEQ ID NO: 38290 - protein, 118 aa, Artificial Sequence; identical to SEQ ID NO: 21205
  Description of Artificial Sequence: Synthetic polypeptide
  VH of XENP20872

SEQ ID NO: 38291 - protein, 5 aa, Artificial Sequence
  Description of Artificial Sequence: Synthetic peptide
  XENP20872 vhCDR1
GYGVN

SEQ ID NO: 38292 - protein, 16 aa, Artificial Sequence
  Description of Artificial Sequence: Synthetic peptide
  XENP20872 vhCDR2
MIWIDGSTDYNSKFQG

SEQ ID NO: 38293 - protein, 10 aa, Artificial Sequence
  Description of Artificial Sequence: Synthetic peptide
  XENP20872 vhCDR3
DRPDGRAMDY

SEQ ID NO: 38294 - protein, 106 aa, Artificial Sequence; identical to SEQ ID NO: 21051
  Description of Artificial Sequence: Synthetic polypeptide
  VL of XENP20872

SEQ ID NO: 38295 - protein, 11 aa, Artificial Sequence
  Description of Artificial Sequence: Synthetic peptide
  XENP20872 vlCDR1
KASQSVSNDVA

SEQ ID NO: 38296 - protein, 7 aa, Artificial Sequence
  Description of Artificial Sequence: Synthetic peptide
  XENP20872 vlCDR2
YASNRYT

SEQ ID NO: 38297 - protein, 8 aa, Artificial Sequence
  Description of Artificial Sequence: Synthetic peptide
  XENP20872 vlCDR3
QQDYSSPT

SEQ ID NO: 38298 - protein, 118 aa, Artificial Sequence; identical to SEQ ID NO: 21305
  Description of Artificial Sequence: Synthetic polypeptide
  VH of XENP020882

SEQ ID NO: 38299 - protein, 5 aa, Artificial Sequence
  Description of Artificial Sequence: Synthetic peptide
  XENP020882 vhCDR1
GYGVN

SEQ ID NO: 38300 - protein, 16 aa, Artificial Sequence
  Description of Artificial Sequence: Synthetic peptide
  XENP020882 vhCDR2
MIWIDGSTDYNSKFQG

SEQ ID NO: 38301 - protein, 10 aa, Artificial Sequence
  Description of Artificial Sequence: Synthetic peptide
  XENP020882 vhCDR3
DRPDGRAMDY

SEQ ID NO: 38302 - protein, 106 aa, Artificial Sequence; identical to SEQ ID NO: 21051
  Description of Artificial Sequence: Synthetic polypeptide
  VL of XENP020882

SEQ ID NO: 38303 - protein, 11 aa, Artificial Sequence
  Description of Artificial Sequence: Synthetic peptide
  XENP020882 vlCDR1
KASQSVSNDVA

SEQ ID NO: 38304 - protein, 7 aa, Artificial Sequence
  Description of Artificial Sequence: Synthetic peptide
  XENP020882 vlCDR2
YASNRYT

SEQ ID NO: 38305 - protein, 8 aa, Artificial Sequence
  Description of Artificial Sequence: Synthetic peptide
  XENP020882 vlCDR3
QQDYSSPT

SEQ ID NO: 38306 - protein, 113 aa, Artificial Sequence; identical to SEQ ID NO: 36628
  Description of Artificial Sequence: Synthetic polypeptide
  VH of XENP21503

SEQ ID NO: 38307 - protein, 5 aa, Artificial Sequence
  Description of Artificial Sequence: Synthetic peptide
  XENP21503 vhCDR1
SFDMS

SEQ ID NO: 38308 - protein, 17 aa, Artificial Sequence
  Description of Artificial Sequence: Synthetic peptide
  XENP21503 vhCDR2
YISSDGASTFYPDTMKG

SEQ ID NO: 38309 - protein, 4 aa, Artificial Sequence
  Description of Artificial Sequence: Synthetic peptide
  XENP21503 vhCDR3
LGAY

SEQ ID NO: 38310 - protein, 112 aa, Artificial Sequence; identical to SEQ ID NO: 36703
  Description of Artificial Sequence: Synthetic polypeptide
  VL of XENP21503

SEQ ID NO: 38311 - protein, 16 aa, Artificial Sequence
  Description of Artificial Sequence: Synthetic peptide
  XENP21503 vlCDR1
KSSQSLLDSDGKTYLN

SEQ ID NO: 38312 - protein, 6 aa, Artificial Sequence
  Description of Artificial Sequence: Synthetic peptide
  XENP21503 vlCDR2
VSKLDS

SEQ ID NO: 38313 - protein, 9 aa, Artificial Sequence
  Description of Artificial Sequence: Synthetic peptide
  XENP21503 vlCDR3
WQGTHFPYT

SEQ ID NO: 38314 - protein, 113 aa, Artificial Sequence; identical to SEQ ID NO: 36628
  Description of Artificial Sequence: Synthetic polypeptide
  VH of XENP21492

SEQ ID NO: 38315 - protein, 5 aa, Artificial Sequence
  Description of Artificial Sequence: Synthetic peptide
  XENP21492 vhCDR1
SFDMS

SEQ ID NO: 38316 - protein, 17 aa, Artificial Sequence
  Description of Artificial Sequence: Synthetic peptide
  XENP21492 vhCDR2
YISSDGASTFYPDTMKG

SEQ ID NO: 38317 - protein, 4 aa, Artificial Sequence
  Description of Artificial Sequence: Synthetic peptide
  XENP21492 vhCDR3
LGAY

SEQ ID NO: 38318 - protein, 111 aa, Artificial Sequence; identical to SEQ ID NO: 36633
  Description of Artificial Sequence: Synthetic polypeptide
  VL of XENP21492

SEQ ID NO: 38319 - protein, 14 aa, Artificial Sequence
  Description of Artificial Sequence: Synthetic peptide
  XENP21492 vlCDR1
RASESVEYYGTSLQ

SEQ ID NO: 38320 - protein, 7 aa, Artificial Sequence
  Description of Artificial Sequence: Synthetic peptide
  XENP21492 vlCDR2
AASNVES

SEQ ID NO: 38321 - protein, 9 aa, Artificial Sequence
  Description of Artificial Sequence: Synthetic peptide
  XENP21492 vlCDR3
QQSRKVPWT

SEQ ID NO: 38322 - protein, 117 aa, Artificial Sequence; identical to SEQ ID NO: 36368
  Description of Artificial Sequence: Synthetic polypeptide
  VH of XENP21189

SEQ ID NO: 38323 - protein, 5 aa, Artificial Sequence
  Description of Artificial Sequence: Synthetic peptide
  XENP21189 vhCDR1
GYGVN

SEQ ID NO: 38324 - protein, 16 aa, Artificial Sequence
  Description of Artificial Sequence: Synthetic peptide
  XENP21189 vhCDR2
MIWGDGSTDYNSALKS

SEQ ID NO: 38325 - protein, 9 aa, Artificial Sequence
  Description of Artificial Sequence: Synthetic peptide
  XENP21189 vhCDR3
SYYTSDEDY

SEQ ID NO: 38326 - protein, 112 aa, Artificial Sequence; identical to SEQ ID NO: 36513
  Description of Artificial Sequence: Synthetic polypeptide
  VL of XENP21189

SEQ ID NO: 38327 - protein, 17 aa, Artificial Sequence
  Description of Artificial Sequence: Synthetic peptide
  XENP21189 vlCDR1
KSSQSLLNSRTRKNYLA

SEQ ID NO: 38328 - protein, 7 aa, Artificial Sequence
  Description of Artificial Sequence: Synthetic peptide
  XENP21189 vlCDR2
WASTRES

SEQ ID NO: 38329 - protein, 8 aa, Artificial Sequence
  Description of Artificial Sequence: Synthetic peptide
  XENP21189 vlCDR3
KQSYSLRT

SEQ ID NO: 38330 - protein, 117 aa, Artificial Sequence; identical to SEQ ID NO: 36638
  Description of Artificial Sequence: Synthetic polypeptide
  VH of XENP21493

SEQ ID NO: 38331 - protein, 5 aa, Artificial Sequence
  Description of Artificial Sequence: Synthetic peptide
  XENP21493 vhCDR1
GYGVN

SEQ ID NO: 38332 - protein, 16 aa, Artificial Sequence
  Description of Artificial Sequence: Synthetic peptide
  XENP21493 vhCDR2
MIWGDGSTDYNSALKS

SEQ ID NO: 38333 - protein, 9 aa, Artificial Sequence
  Description of Artificial Sequence: Synthetic peptide
  XENP21493 vhCDR3
SYYTSDEDY

SEQ ID NO: 38334 - protein, 107 aa, Artificial Sequence; identical to SEQ ID NO: 36643
  Description of Artificial Sequence: Synthetic polypeptide
  VL of XENP21493

SEQ ID NO: 38335 - protein, 11 aa, Artificial Sequence
  Description of Artificial Sequence: Synthetic peptide
  XENP21493 vlCDR1
KASQNVGSNVA

SEQ ID NO: 38336 - protein, 7 aa, Artificial Sequence
  Description of Artificial Sequence: Synthetic peptide
  XENP21493 vlCDR2
SASFRYS

SEQ ID NO: 38337 - protein, 9 aa, Artificial Sequence
  Description of Artificial Sequence: Synthetic peptide
  XENP21493 vlCDR3
QQYNSYPYT

SEQ ID NO: 38338 - protein, 117 aa, Artificial Sequence; identical to SEQ ID NO: 36648
  Description of Artificial Sequence: Synthetic polypeptide
  VH of XENP21494

SEQ ID NO: 38339 - protein, 5 aa, Artificial Sequence
  Description of Artificial Sequence: Synthetic peptide
  XENP21494 vhCDR1
SYGVH

SEQ ID NO: 38340 - protein, 16 aa, Artificial Sequence
  Description of Artificial Sequence: Synthetic peptide
  XENP21494 vhCDR2
VIWSGGSTEYNAAFIS

SEQ ID NO: 38341 - protein, 9 aa, Artificial Sequence
  Description of Artificial Sequence: Synthetic peptide
  XENP21494 vhCDR3
GGLLSPFDY

SEQ ID NO: 38342 - protein, 111 aa, Artificial Sequence; identical to SEQ ID NO: 36633
  Description of Artificial Sequence: Synthetic polypeptide
  VL of XENP21494

SEQ ID NO: 38343 - protein, 15 aa, Artificial Sequence
  Description of Artificial Sequence: Synthetic peptide
  XENP21494 vlCDR1
RASESVEYYGTSLMQ

SEQ ID NO: 38344 - protein, 7 aa, Artificial Sequence
  Description of Artificial Sequence: Synthetic peptide
  XENP21494 vlCDR2
AASNVES

SEQ ID NO: 38345 - protein, 9 aa, Artificial Sequence
  Description of Artificial Sequence: Synthetic peptide
  XENP21494 vlCDR3
QQSRKVPWT

SEQ ID NO: 38346 - protein, 123 aa, Artificial Sequence; identical to SEQ ID NO: 36658
  Description of Artificial Sequence: Synthetic polypeptide
  VH of XENP21495

SEQ ID NO: 38347 - protein, 5 aa, Artificial Sequence
  Description of Artificial Sequence: Synthetic peptide
  XENP21495 vhCDR1
RYWMS

SEQ ID NO: 38348 - protein, 17 aa, Artificial Sequence
  Description of Artificial Sequence: Synthetic peptide
  XENP21495 vhCDR2
EINPDSSTINYTPSLKD

SEQ ID NO: 38349 - protein, 14 aa, Artificial Sequence
  Description of Artificial Sequence: Synthetic peptide
  XENP21495 vhCDR3
PNGYYVGTIFPFAY

SEQ ID NO: 38350 - protein, 110 aa, Artificial Sequence
  Description of Artificial Sequence: Synthetic polypeptide
  VL of XENP21495
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 38351 - protein, 14 aa, Artificial Sequence
  Description of Artificial Sequence: Synthetic peptide
  XENP21495 vlCDR1
RSSTGAVTTSNYAN

SEQ ID NO: 38352 - protein, 7 aa, Artificial Sequence
  Description of Artificial Sequence: Synthetic peptide
  XENP21495 vlCDR2
GTNNRAP

SEQ ID NO: 38353 - protein, 9 aa, Artificial Sequence
  Description of Artificial Sequence: Synthetic peptide
  XENP21495 vlCDR3
ALWYSNHWV

SEQ ID NO: 38354 - protein, 118 aa, Artificial Sequence; identical to SEQ ID NO: 20836
  Description of Artificial Sequence: Synthetic polypeptide
  VH of XENP21496

SEQ ID NO: 38355 - protein, 5 aa, Artificial Sequence
  Description of Artificial Sequence: Synthetic peptide
  XENP21496 vhCDR1
SYAVN

SEQ ID NO: 38356 - protein, 16 aa, Artificial Sequence
  Description of Artificial Sequence: Synthetic peptide
  XENP21496 vhCDR2
VIWSGGSTDYNAAFIS

SEQ ID NO: 38357 - protein, 10 aa, Artificial Sequence
  Description of Artificial Sequence: Synthetic peptide
  XENP21496 vhCDR3
LYYRYDGFDY

SEQ ID NO: 38358 - protein, 107 aa, Artificial Sequence; identical to SEQ ID NO: 20841
  Description of Artificial Sequence: Synthetic polypeptide
  VL of XENP21496

SEQ ID NO: 38359 - protein, 11 aa, Artificial Sequence
  Description of Artificial Sequence: Synthetic peptide
  XENP21496 vlCDR1
KASQNVGTHVA

SEQ ID NO: 38360 - protein, 7 aa, Artificial Sequence
  Description of Artificial Sequence: Synthetic peptide
  XENP21496 vlCDR2
SASYRYS

SEQ ID NO: 38361 - protein, 9 aa, Artificial Sequence
  Description of Artificial Sequence: Synthetic peptide
  XENP21496 vlCDR3
QQYNSYPLT

SEQ ID NO: 38362 - protein, 118 aa, Artificial Sequence; identical to SEQ ID NO: 20846
  Description of Artificial Sequence: Synthetic polypeptide
  VH of XENP21501

SEQ ID NO: 38363 - protein, 5 aa, Artificial Sequence
  Description of Artificial Sequence: Synthetic peptide
  XENP21501 vhCDR1
SYAVN

SEQ ID NO: 38364 - protein, 16 aa, Artificial Sequence
  Description of Artificial Sequence: Synthetic peptide
  XENP21501 vhCDR2
VIWSGGSTDYNAAFIS

SEQ ID NO: 38365 - protein, 10 aa, Artificial Sequence
  Description of Artificial Sequence: Synthetic peptide
  XENP21501 vhCDR3
LYYRYDGFDY

SEQ ID NO: 38366 - protein, 107 aa, Artificial Sequence; identical to SEQ ID NO: 20841
  Description of Artificial Sequence: Synthetic polypeptide
  VL of XENP21501

SEQ ID NO: 38367 - protein, 11 aa, Artificial Sequence
  Description of Artificial Sequence: Synthetic peptide
  XENP21501 vlCDR1
KASQNVGTHVA

SEQ ID NO: 38368 - protein, 7 aa, Artificial Sequence
  Description of Artificial Sequence: Synthetic peptide
  XENP21501 vlCDR2
SASYRYS

SEQ ID NO: 38369 - protein, 9 aa, Artificial Sequence
  Description of Artificial Sequence: Synthetic peptide
  XENP21501 vlCDR3
QQYNSYPLT

SEQ ID NO: 38370 - protein, 117 aa, Artificial Sequence; identical to SEQ ID NO: 36688
  Description of Artificial Sequence: Synthetic polypeptide
  VH of XENP21502

SEQ ID NO: 38371 - protein, 5 aa, Artificial Sequence
  Description of Artificial Sequence: Synthetic peptide
  XENP21502 vhCDR1
RYAMS

SEQ ID NO: 38372 - protein, 16 aa, Artificial Sequence
  Description of Artificial Sequence: Synthetic peptide
  XENP21502 vhCDR2
SISSGGSTYYPDSVQG

SEQ ID NO: 38373 - protein, 9 aa, Artificial Sequence
  Description of Artificial Sequence: Synthetic peptide
  XENP21502 vhCDR3
GDYEGYFDY

SEQ ID NO: 38374 - protein, 113 aa, Artificial Sequence; identical to SEQ ID NO: 36693
  Description of Artificial Sequence: Synthetic polypeptide
  VL of XENP21502

SEQ ID NO: 38375 - protein, 17 aa, Artificial Sequence
  Description of Artificial Sequence: Synthetic peptide
  XENP21502 vlCDR1
KSSQSLLNSINQKNYLA

SEQ ID NO: 38376 - protein, 7 aa, Artificial Sequence
  Description of Artificial Sequence: Synthetic peptide
  XENP21502 vlCDR2
FASTRES

SEQ ID NO: 38377 - protein, 9 aa, Artificial Sequence
  Description of Artificial Sequence: Synthetic peptide
  XENP21502 vlCDR3
QQHYSTPLT

SEQ ID NO: 38378 - protein, 447 aa, Artificial Sequence; identical to SEQ ID NO: 23356
  Description of Artificial Sequence: Synthetic polypeptide
  XENP019738 ipilimumab_H3L0-1G6_L1.210_H1.288 Fab-Fc Heavy Chain

SEQ ID NO: 38379 - protein, 118 aa, Artificial Sequence; identical to SEQ ID NO: 139
  Description of Artificial Sequence: Synthetic polypeptide
  VH of XENP019738

SEQ ID NO: 38380 - protein, 5 aa, Artificial Sequence
  Description of Artificial Sequence: Synthetic peptide
  XENP019738 vhCDR1
SYTMH

SEQ ID NO: 38381 - protein, 17 aa, Artificial Sequence
  Description of Artificial Sequence: Synthetic peptide
  XENP019738 vhCDR2
FISYDGNNKYYADSVKG

SEQ ID NO: 38382 - protein, 9 aa, Artificial Sequence
  Description of Artificial Sequence: Synthetic peptide
  XENP019738 vhCDR3
TGWLGPFDY

SEQ ID NO: 38383 - protein, 480 aa, Artificial Sequence; identical to SEQ ID NO: 23381
  Description of Artificial Sequence: Synthetic polypeptide
  XENP019738 ipilimumab_H3L0-1G6_L1.210_H1.288 scFv-Fc Heavy Chain

SEQ ID NO: 38384 - protein, 107 aa, Artificial Sequence; identical to SEQ ID NO: 11359
  Description of Artificial Sequence: Synthetic polypeptide
  VH of XENP019738

SEQ ID NO: 38385 - protein, 122 aa, Artificial Sequence; identical to SEQ ID NO: 11358
  Description of Artificial Sequence: Synthetic polypeptide
  VL of XENP019738

SEQ ID NO: 38386 - protein, 231 aa, Artificial Sequence; identical to SEQ ID NO: 21532
  Description of Artificial Sequence: Synthetic polypeptide
  Fc chain of XENP019738

SEQ ID NO: 38387 - protein, 11 aa, Artificial Sequence
  Description of Artificial Sequence: Synthetic peptide
  XENP019738 vhCDR1
RASQSVGNDVA

SEQ ID NO: 38388 - protein, 7 aa, Artificial Sequence
  Description of Artificial Sequence: Synthetic peptide
  XENP019738 vhCDR2
YASHRYT

SEQ ID NO: 38389 - protein, 9 aa, Artificial Sequence
  Description of Artificial Sequence: Synthetic peptide
  XENP019738 vhCDR3
QQDFSSPRT

SEQ ID NO: 38390 - protein, 5 aa, Artificial Sequence
  Description of Artificial Sequence: Synthetic peptide
  XENP019738 vlCDR1
NYWMN

SEQ ID NO: 38391 - protein, 19 aa, Artificial Sequence
  Description of Artificial Sequence: Synthetic peptide
  XENP019738 vlCDR2
EIRLYSNNYATHYAESVKG

SEQ ID NO: 38392 - protein, 11 aa, Artificial Sequence
  Description of Artificial Sequence: Synthetic peptide
  XENP019738 vlCDR3
YYGNYGGYFDV

SEQ ID NO: 38393 - protein, 215 aa, Artificial Sequence; identical to SEQ ID NO: 2924
  Description of Artificial Sequence: Synthetic polypeptide
  XENP019738 ipilimumab_H3L0-1G6_L1.210_H1.288 Light Chain

SEQ ID NO: 38394 - protein, 108 aa, Artificial Sequence; identical to SEQ ID NO: 23
  Description of Artificial Sequence: Synthetic polypeptide
  VL of XENP019738

SEQ ID NO: 38395 - protein, 12 aa, Artificial Sequence
  Description of Artificial Sequence: Synthetic peptide
  XENP019738 vlCDR1
RASQSVGSSYLA

SEQ ID NO: 38396 - protein, 7 aa, Artificial Sequence
  Description of Artificial Sequence: Synthetic peptide
  XENP019738 vlCDR2
GAFSRAT

SEQ ID NO: 38397 - protein, 9 aa, Artificial Sequence
  Description of Artificial Sequence: Synthetic peptide
  XENP019738 vlCDR3
QQYGSSPWT

SEQ ID NO: 38398 - protein, 447 aa, Artificial Sequence; identical to SEQ ID NO: 23356
  Description of Artificial Sequence: Synthetic polypeptide
  XENP019739 ipilimumab_H3L0-1G6_H1.279_L1.194 Fab-Fc Heavy Chain

SEQ ID NO: 38399 - protein, 118 aa, Artificial Sequence; identical to SEQ ID NO: 139
  Description of Artificial Sequence: Synthetic polypeptide
  VH of XENP019739

SEQ ID NO: 38400 - protein, 5 aa, Artificial Sequence
  Description of Artificial Sequence: Synthetic peptide
  XENP019739 vhCDR1
SYTMH

SEQ ID NO: 38401 - protein, 17 aa, Artificial Sequence
  Description of Artificial Sequence: Synthetic peptide
  XENP019739 vhCDR2
FISYDGNNKYYADSVKG

SEQ ID NO: 38402 - protein, 9 aa, Artificial Sequence
  Description of Artificial Sequence: Synthetic peptide
  XENP019739 vhCDR3
TGWLGPFDY

SEQ ID NO: 38403 - protein, 480 aa, Artificial Sequence; identical to SEQ ID NO: 23401
  Description of Artificial Sequence: Synthetic polypeptide
  XENP019739 ipilimumab_H3L0-1G6_H1.279_L1.194 scFv-Fc Heavy Chain

SEQ ID NO: 38404 - protein, 122 aa, Artificial Sequence; identical to SEQ ID NO: 10908
  Description of Artificial Sequence: Synthetic polypeptide
  VH of XENP019739

SEQ ID NO: 38405 - protein, 107 aa, Artificial Sequence; identical to SEQ ID NO: 10999
  Description of Artificial Sequence: Synthetic polypeptide
  VL of XENP019739

SEQ ID NO: 38406 - protein, 231 aa, Artificial Sequence; identical to SEQ ID NO: 21532
  Description of Artificial Sequence: Synthetic polypeptide
  Fc chain of XENP019739

SEQ ID NO: 38407 - protein, 5 aa, Artificial Sequence
  Description of Artificial Sequence: Synthetic peptide
  XENP019739 vhCDR1
NYWMN

SEQ ID NO: 38408 - protein, 19 aa, Artificial Sequence
  Description of Artificial Sequence: Synthetic peptide
  XENP019739 vhCDR2
EIRLYSNNYATHYAESVKG

SEQ ID NO: 38409 - protein, 11 aa, Artificial Sequence
  Description of Artificial Sequence: Synthetic peptide
  XENP019739 vhCDR3
YYGNYGGYFDV

SEQ ID NO: 38410 - protein, 11 aa, Artificial Sequence
  Description of Artificial Sequence: Synthetic peptide
  XENP019739 vlCDR1
RASQSVGNDVA

SEQ ID NO: 38411 - protein, 7 aa, Artificial Sequence
  Description of Artificial Sequence: Synthetic peptide
  XENP019739 vlCDR2
YASHRYT

SEQ ID NO: 38412 - protein, 9 aa, Artificial Sequence
  Description of Artificial Sequence: Synthetic peptide
  XENP019739 vlCDR3
QQDFSSPRT

SEQ ID NO: 38413 - protein, 215 aa, Artificial Sequence; identical to SEQ ID NO: 2924
  Description of Artificial Sequence: Synthetic polypeptide
  XENP019739 ipilimumab_H3L0-1G6_H1.279_L1.194 Light Chain

SEQ ID NO: 38414 - protein, 108 aa, Artificial Sequence; identical to SEQ ID NO: 23
  Description of Artificial Sequence: Synthetic polypeptide
  VL of XENP019739

SEQ ID NO: 38415 - protein, 12 aa, Artificial Sequence
  Description of Artificial Sequence: Synthetic peptide
  XENP019739 vlCDR1
RASQSVGSSYLA

SEQ ID NO: 38416 - protein, 7 aa, Artificial Sequence
  Description of Artificial Sequence: Synthetic peptide
  XENP019739 vlCDR2
GAFSRAT

SEQ ID NO: 38417 - protein, 9 aa, Artificial Sequence
  Description of Artificial Sequence: Synthetic peptide
  XENP019739 vlCDR3
QQYGSSPWT

SEQ ID NO: 38418 - protein, 447 aa, Artificial Sequence; identical to SEQ ID NO: 23356
  Description of Artificial Sequence: Synthetic polypeptide
  XENP019741 ipilimumab_H3L0-1G6_L1.194_H1.279 Fab-Fc Heavy Chain

SEQ ID NO: 38419 - protein, 118 aa, Artificial Sequence; identical to SEQ ID NO: 139
  Description of Artificial Sequence: Synthetic polypeptide
  VH of XENP019741

SEQ ID NO: 38420 - protein, 5 aa, Artificial Sequence
  Description of Artificial Sequence: Synthetic peptide
  XENP019741 vhCDR1
SYTMH

SEQ ID NO: 38421 - protein, 17 aa, Artificial Sequence
  Description of Artificial Sequence: Synthetic peptide
  XENP019741 vhCDR2
FISYDGNNKYYADSVKG

SEQ ID NO: 38422 - protein, 9 aa, Artificial Sequence
  Description of Artificial Sequence: Synthetic peptide
  XENP019741 vhCDR3
TGWLGPFDY

SEQ ID NO: 38423 - protein, 480 aa, Artificial Sequence; identical to SEQ ID NO: 23221
  Description of Artificial Sequence: Synthetic polypeptide
  XENP019741 ipilimumab_H3L0-1G6_L1.194_H1.279 scFv-Fc Heavy Chain

SEQ ID NO: 38424 - protein, 107 aa, Artificial Sequence; identical to SEQ ID NO: 10999
  Description of Artificial Sequence: Synthetic polypeptide
  VH of XENP019741

SEQ ID NO: 38425 - protein, 122 aa, Artificial Sequence; identical to SEQ ID NO: 10908
  Description of Artificial Sequence: Synthetic polypeptide
  VL of XENP019741

SEQ ID NO: 38426 - protein, 231 aa, Artificial Sequence; identical to SEQ ID NO: 21532
  Description of Artificial Sequence: Synthetic polypeptide
  Fc chain of XENP019741

SEQ ID NO: 38427 - protein, 11 aa, Artificial Sequence
  Description of Artificial Sequence: Synthetic peptide
  XENP019741 vhCDR1
RASQSVGNDVA

SEQ ID NO: 38428 - protein, 7 aa, Artificial Sequence
  Description of Artificial Sequence: Synthetic peptide
  XENP019741 vhCDR2
YASHRYT

SEQ ID NO: 38429 - protein, 9 aa, Artificial Sequence
  Description of Artificial Sequence: Synthetic peptide
  XENP019741 vhCDR3
QQDFSSPRT

SEQ ID NO: 38430 - protein, 5 aa, Artificial Sequence
  Description of Artificial Sequence: Synthetic peptide
  XENP019741 vlCDR1
NYWMN

SEQ ID NO: 38431 - protein, 19 aa, Artificial Sequence
  Description of Artificial Sequence: Synthetic peptide
  XENP019741 vlCDR2
EIRLYSNNYATHYAESVKG

SEQ ID NO: 38432 - protein, 11 aa, Artificial Sequence
  Description of Artificial Sequence: Synthetic peptide
  XENP019741 vlCDR3
YYGNYGGYFDV

SEQ ID NO: 38433 - protein, 215 aa, Artificial Sequence; identical to SEQ ID NO: 2924
  Description of Artificial Sequence: Synthetic polypeptide
  XENP019741 ipilimumab_H3L0-1G6_L1.194_H1.279 Light Chain

SEQ ID NO: 38434 - protein, 108 aa, Artificial Sequence; identical to SEQ ID NO: 23
  Description of Artificial Sequence: Synthetic polypeptide
  VL of XENP019741

SEQ ID NO: 38435 - protein, 12 aa, Artificial Sequence
  Description of Artificial Sequence: Synthetic peptide
  XENP019741 vlCDR1
RASQSVGSSYLA

SEQ ID NO: 38436 - protein, 7 aa, Artificial Sequence
  Description of Artificial Sequence: Synthetic peptide
  XENP019741 vlCDR2
GAFSRAT

SEQ ID NO: 38437 - protein, 9 aa, Artificial Sequence
  Description of Artificial Sequence: Synthetic peptide
  XENP019741 vlCDR3
QQYGSSPWT

SEQ ID NO: 38438 - protein, 447 aa, Artificial Sequence; identical to SEQ ID NO: 23356
  Description of Artificial Sequence: Synthetic polypeptide
  XENP020053 ipilimumab_H3L0.22-1G6_L1.194_H1.279 Fab-Fc Heavy Chain

SEQ ID NO: 38439 - protein, 118 aa, Artificial Sequence; identical to SEQ ID NO: 139
  Description of Artificial Sequence: Synthetic polypeptide
  VH of XENP020053

SEQ ID NO: 38440 - protein, 5 aa, Artificial Sequence
  Description of Artificial Sequence: Synthetic peptide
  XENP020053 vhCDR1
SYTMH

SEQ ID NO: 38441 - protein, 17 aa, Artificial Sequence
  Description of Artificial Sequence: Synthetic peptide
  XENP020053 vhCDR2
FISYDGNNKYYADSVKG

SEQ ID NO: 38442 - protein, 9 aa, Artificial Sequence
  Description of Artificial Sequence: Synthetic peptide
  XENP020053 vhCDR3
TGWLGPFDY

SEQ ID NO: 38443 - protein, 480 aa, Artificial Sequence; identical to SEQ ID NO: 23221
  Description of Artificial Sequence: Synthetic polypeptide
  XENP020053 ipilimumab_H3L0.22-1G6_L1.194_H1.279 scFv-Fc Heavy Chain

SEQ ID NO: 38444 - protein, 107 aa, Artificial Sequence; identical to SEQ ID NO: 10999
  Description of Artificial Sequence: Synthetic polypeptide
  VH of XENP020053

SEQ ID NO: 38445 - protein, 122 aa, Artificial Sequence; identical to SEQ ID NO: 10908
  Description of Artificial Sequence: Synthetic polypeptide
  VL of XENP020053

SEQ ID NO: 38446 - protein, 231 aa, Artificial Sequence; identical to SEQ ID NO: 21532
  Description of Artificial Sequence: Synthetic polypeptide
  Fc chain of XENP020053

SEQ ID NO: 38447 - protein, 11 aa, Artificial Sequence
  Description of Artificial Sequence: Synthetic peptide
  XENP020053 vhCDR1
RASQSVGNDVA

SEQ ID NO: 38448 - protein, 7 aa, Artificial Sequence
  Description of Artificial Sequence: Synthetic peptide
  XENP020053 vhCDR2
YASHRYT

SEQ ID NO: 38449 - protein, 9 aa, Artificial Sequence
  Description of Artificial Sequence: Synthetic peptide
  XENP020053 vhCDR3
QQDFSSPRT

SEQ ID NO: 38450 - protein, 5 aa, Artificial Sequence
  Description of Artificial Sequence: Synthetic peptide
  XENP020053 vlCDR1
NYWMN

SEQ ID NO: 38451 - protein, 19 aa, Artificial Sequence
  Description of Artificial Sequence: Synthetic peptide
  XENP020053 vlCDR2
EIRLYSNNYATHYAESVKG

SEQ ID NO: 38452 - protein, 11 aa, Artificial Sequence
  Description of Artificial Sequence: Synthetic peptide
  XENP020053 vlCDR3
YYGNYGGYFDV

SEQ ID NO: 38453 - protein, 215 aa, Artificial Sequence; identical to SEQ ID NO: 4504
  Description of Artificial Sequence: Synthetic polypeptide
  XENP020053 ipilimumab_H3L0.22-1G6_L1.194_H1.279 Light Chain

SEQ ID NO: 38454 - protein, 108 aa, Artificial Sequence; identical to SEQ ID NO: 1607
  Description of Artificial Sequence: Synthetic polypeptide
  VL of XENP020053

SEQ ID NO: 38455 - protein, 12 aa, Artificial Sequence
  Description of Artificial Sequence: Synthetic peptide
  XENP020053 vlCDR1
RASQSVSSSYLA

SEQ ID NO: 38456 - protein, 7 aa, Artificial Sequence
  Description of Artificial Sequence: Synthetic peptide
  XENP020053 vlCDR2
GAFSRAT

SEQ ID NO: 38457 - protein, 9 aa, Artificial Sequence
  Description of Artificial Sequence: Synthetic peptide
  XENP020053 vlCDR3
QQYGSSPWT

SEQ ID NO: 38458 - protein, 447 aa, Artificial Sequence; identical to SEQ ID NO: 23356
  Description of Artificial Sequence: Synthetic polypeptide
  XENP020066 ipilimumab_H3_L0.22-1G6_H1.279_L1.194 Fab-Fc Heavy Chain

SEQ ID NO: 38459 - protein, 118 aa, Artificial Sequence; identical to SEQ ID NO: 139
  Description of Artificial Sequence: Synthetic polypeptide
  VH of XENP020066

SEQ ID NO: 38460 - protein, 5 aa, Artificial Sequence
  Description of Artificial Sequence: Synthetic peptide
  XENP020066 vhCDR1
SYTMH

SEQ ID NO: 38461 - protein, 17 aa, Artificial Sequence
  Description of Artificial Sequence: Synthetic peptide
  XENP020066 vhCDR2
FISYDGNNKYYADSVKG

SEQ ID NO: 38462 - protein, 9 aa, Artificial Sequence
  Description of Artificial Sequence: Synthetic peptide
  XENP020066 vhCDR3
TGWLGPFDY

SEQ ID NO: 38463 - protein, 480 aa, Artificial Sequence; identical to SEQ ID NO: 23401
  Description of Artificial Sequence: Synthetic polypeptide
  XENP020066 ipilimumab_H3_L0.22-1G6_H1.279_L1.194 scFv-Fc Heavy Chain

SEQ ID NO: 38464 - protein, 122 aa, Artificial Sequence; identical to SEQ ID NO: 10908
  Description of Artificial Sequence: Synthetic polypeptide
  VH of XENP020066

SEQ ID NO: 38465 - protein, 107 aa, Artificial Sequence; identical to SEQ ID NO: 10999
  Description of Artificial Sequence: Synthetic polypeptide
  VL of XENP020066

SEQ ID NO: 38466 - protein, 231 aa, Artificial Sequence; identical to SEQ ID NO: 21532
  Description of Artificial Sequence: Synthetic polypeptide
  Fc chain of XENP020066

SEQ ID NO: 38467 - protein, 5 aa, Artificial Sequence
  Description of Artificial Sequence: Synthetic peptide
  XENP020066 vhCDR1
NYWMN

SEQ ID NO: 38468 - protein, 19 aa, Artificial Sequence
  Description of Artificial Sequence: Synthetic peptide
  XENP020066 vhCDR2
EIRLYSNNYATHYAESVKG

SEQ ID NO: 38469 - protein, 11 aa, Artificial Sequence
  Description of Artificial Sequence: Synthetic peptide
  XENP020066 vhCDR3
YYGNYGGYFDV

SEQ ID NO: 38470 - protein, 11 aa, Artificial Sequence
  Description of Artificial Sequence: Synthetic peptide
  XENP020066 vlCDR1
RASQSVGNDVA

SEQ ID NO: 38471 - protein, 7 aa, Artificial Sequence
  Description of Artificial Sequence: Synthetic peptide
  XENP020066 vlCDR2
YASHRYT

SEQ ID NO: 38472 - protein, 9 aa, Artificial Sequence
  Description of Artificial Sequence: Synthetic peptide
  XENP020066 vlCDR3
QQDFSSPRT

SEQ ID NO: 38473 - protein, 215 aa, Artificial Sequence; identical to SEQ ID NO: 4504
  Description of Artificial Sequence: Synthetic polypeptide
  XENP020066 ipilimumab_H3_L0.22-1G6_H1.279_L1.194 Light Chain

SEQ ID NO: 38474 - protein, 108 aa, Artificial Sequence; identical to SEQ ID NO: 1607
  Description of Artificial Sequence: Synthetic polypeptide
  VL of XENP020066

SEQ ID NO: 38475 - protein, 12 aa, Artificial Sequence
  Description of Artificial Sequence: Synthetic peptide
  XENP020066 vlCDR1
RASQSVSSSYLA

SEQ ID NO: 38476 - protein, 7 aa, Artificial Sequence
  Description of Artificial Sequence: Synthetic peptide
  XENP020066 vlCDR2
GAFSRAT

SEQ ID NO: 38477 - protein, 9 aa, Artificial Sequence
  Description of Artificial Sequence: Synthetic peptide
  XENP020066 vlCDR3
QQYGSSPWT

SEQ ID NO: 38478 - protein, 447 aa, Artificial Sequence; identical to SEQ ID NO: 23356
  Description of Artificial Sequence: Synthetic polypeptide
  XENP020130 ipilimumab_H3_L0.22-1G6_L1.210_H1.288 Fab-Fc Heavy Chain

SEQ ID NO: 38479 - protein, 118 aa, Artificial Sequence; identical to SEQ ID NO: 139
  Description of Artificial Sequence: Synthetic polypeptide
  VH of XENP020130

SEQ ID NO: 38480 - protein, 5 aa, Artificial Sequence
  Description of Artificial Sequence: Synthetic peptide
  XENP020130 vhCDR1
SYTMH

SEQ ID NO: 38481 - protein, 17 aa, Artificial Sequence
  Description of Artificial Sequence: Synthetic peptide
  XENP020130 vhCDR2
FISYDGNNKYYADSVKG

SEQ ID NO: 38482 - protein, 9 aa, Artificial Sequence
  Description of Artificial Sequence: Synthetic peptide
  XENP020130 vhCDR3
TGWLGPFDY

SEQ ID NO: 38483 - protein, 480 aa, Artificial Sequence; identical to SEQ ID NO: 23381
  Description of Artificial Sequence: Synthetic polypeptide
  XENP020130 ipilimumab_H3_L0.22-1G6_L1.210_H1.288 scFv-Fc Heavy Chain

SEQ ID NO: 38484 - protein, 107 aa, Artificial Sequence; identical to SEQ ID NO: 11359
  Description of Artificial Sequence: Synthetic polypeptide
  VH of XENP020130

SEQ ID NO: 38485 - protein, 122 aa, Artificial Sequence; identical to SEQ ID NO: 11358
  Description of Artificial Sequence: Synthetic polypeptide
  VL of XENP020130

SEQ ID NO: 38486 - protein, 231 aa, Artificial Sequence; identical to SEQ ID NO: 21532
  Description of Artificial Sequence: Synthetic polypeptide
  Fc chain of XENP020130

SEQ ID NO: 38487 - protein, 11 aa, Artificial Sequence
  Description of Artificial Sequence: Synthetic peptide
  XENP020130 vhCDR1
RASQSVGNDVA

SEQ ID NO: 38488 - protein, 7 aa, Artificial Sequence
  Description of Artificial Sequence: Synthetic peptide
  XENP020130 vhCDR2
YASHRYT

SEQ ID NO: 38489 - protein, 9 aa, Artificial Sequence
  Description of Artificial Sequence: Synthetic peptide
  XENP020130 vhCDR3
QQDFSSPRT

SEQ ID NO: 38490 - protein, 5 aa, Artificial Sequence
  Description of Artificial Sequence: Synthetic peptide
  XENP020130 vlCDR1
NYWMN

SEQ ID NO: 38491 - protein, 19 aa, Artificial Sequence
  Description of Artificial Sequence: Synthetic peptide
  XENP020130 vlCDR2
EIRLYSNNYATHYAESVKG

SEQ ID NO: 38492 - protein, 11 aa, Artificial Sequence
  Description of Artificial Sequence: Synthetic peptide
  XENP020130 vlCDR3
YYGNYGGYFDV

SEQ ID NO: 38493 - protein, 215 aa, Artificial Sequence; identical to SEQ ID NO: 4504
  Description of Artificial Sequence: Synthetic polypeptide
  XENP020130 ipilimumab_H3_L0.22-1G6_L1.210_H1.288 Light Chain

SEQ ID NO: 38494 - protein, 108 aa, Artificial Sequence; identical to SEQ ID NO: 1607
  Description of Artificial Sequence: Synthetic polypeptide
  VL of XENP020130

SEQ ID NO: 38495 - protein, 12 aa, Artificial Sequence
  Description of Artificial Sequence: Synthetic peptide
  XENP020130 vlCDR1
RASQSVSSSYLA

SEQ ID NO: 38496 - protein, 7 aa, Artificial Sequence
  Description of Artificial Sequence: Synthetic peptide
  XENP020130 vlCDR2
GAFSRAT

SEQ ID NO: 38497 - protein, 9 aa, Artificial Sequence
  Description of Artificial Sequence: Synthetic peptide
  XENP020130 vlCDR3
QQYGSSPWT

SEQ ID NO: 38498 - protein, 447 aa, Artificial Sequence; identical to SEQ ID NO: 23356
  Description of Artificial Sequence: Synthetic polypeptide
  XENP020146 ipilimumab_H3_L0.22-1G6_H1.280_L1.224 Fab-Fc Heavy Chain

SEQ ID NO: 38499 - protein, 118 aa, Artificial Sequence; identical to SEQ ID NO: 139
  Description of Artificial Sequence: Synthetic polypeptide
  VH of XENP020146

SEQ ID NO: 38500 - protein, 5 aa, Artificial Sequence
  Description of Artificial Sequence: Synthetic peptide
  XENP020146 vhCDR1
SYTMH

SEQ ID NO: 38501 - protein, 17 aa, Artificial Sequence
  Description of Artificial Sequence: Synthetic peptide
  XENP020146 vhCDR2
FISYDGNNKYYADSVKG

SEQ ID NO: 38502 - protein, 9 aa, Artificial Sequence
  Description of Artificial Sequence: Synthetic peptide
  XENP020146 vhCDR3
TGWLGPFDY

SEQ ID NO: 38503 - protein, 480 aa, Artificial Sequence; identical to SEQ ID NO: 22809
  Description of Artificial Sequence: Synthetic polypeptide
  XENP020146 ipilimumab_H3_L0.22-1G6_H1.280_L1.224 scFv-Fc Heavy Chain

SEQ ID NO: 38504 - protein, 122 aa, Artificial Sequence; identical to SEQ ID NO: 10917
  Description of Artificial Sequence: Synthetic polypeptide
  VH of XENP020146

SEQ ID NO: 38505 - protein, 107 aa, Artificial Sequence; identical to SEQ ID NO: 22811
  Description of Artificial Sequence: Synthetic polypeptide
  VL of XENP020146

SEQ ID NO: 38506 - protein, 231 aa, Artificial Sequence; identical to SEQ ID NO: 21532
  Description of Artificial Sequence: Synthetic polypeptide
  Fc chain of XENP020146

SEQ ID NO: 38507 - protein, 5 aa, Artificial Sequence
  Description of Artificial Sequence: Synthetic peptide
  XENP020146 vhCDR1
NYWMN

SEQ ID NO: 38508 - protein, 19 aa, Artificial Sequence
  Description of Artificial Sequence: Synthetic peptide
  XENP020146 vhCDR2
EIRLYSNNYATHYAESVKG

SEQ ID NO: 38509 - protein, 11 aa, Artificial Sequence
  Description of Artificial Sequence: Synthetic peptide
  XENP020146 vhCDR3
YYGNYGGYFDV

SEQ ID NO: 38510 - protein, 11 aa, Artificial Sequence
  Description of Artificial Sequence: Synthetic peptide
  XENP020146 vlCDR1
RASQSVGNDVA

SEQ ID NO: 38511 - protein, 7 aa, Artificial Sequence
  Description of Artificial Sequence: Synthetic peptide
  XENP020146 vlCDR2
YASHRYT

SEQ ID NO: 38512 - protein, 9 aa, Artificial Sequence
  Description of Artificial Sequence: Synthetic peptide
  XENP020146 vlCDR3
QQDWSSPRT

SEQ ID NO: 38513 - protein, 215 aa, Artificial Sequence; identical to SEQ ID NO: 4504
  Description of Artificial Sequence: Synthetic polypeptide
  XENP020146 ipilimumab_H3_L0.22-1G6_H1.280_L1.224 Light Chain

SEQ ID NO: 38514 - protein, 108 aa, Artificial Sequence; identical to SEQ ID NO: 1607
  Description of Artificial Sequence: Synthetic polypeptide
  VL of XENP020146

SEQ ID NO: 38515 - protein, 12 aa, Artificial Sequence
  Description of Artificial Sequence: Synthetic peptide
  XENP020146 vlCDR1
RASQSVSSSYLA

SEQ ID NO: 38516 - protein, 7 aa, Artificial Sequence
  Description of Artificial Sequence: Synthetic peptide
  XENP020146 vlCDR2
GAFSRAT

SEQ ID NO: 38517 - protein, 9 aa, Artificial Sequence
  Description of Artificial Sequence: Synthetic peptide
  XENP020146 vlCDR3
QQYGSSPWT

SEQ ID NO: 38518 - protein, 447 aa, Artificial Sequence; identical to SEQ ID NO: 23556
  Description of Artificial Sequence: Synthetic polypeptide
  XENP020717 ipilimumab_H3_L0.22-1G6_L1.194_H1.279 M428L/N434S Fab-Fc Heavy Chain

SEQ ID NO: 38519 - protein, 118 aa, Artificial Sequence; identical to SEQ ID NO: 139
  Description of Artificial Sequence: Synthetic polypeptide
  VH of XENP020717

SEQ ID NO: 38520 - protein, 5 aa, Artificial Sequence
  Description of Artificial Sequence: Synthetic peptide
  XENP020717 vhCDR1
SYTMH

SEQ ID NO: 38521 - protein, 17 aa, Artificial Sequence
  Description of Artificial Sequence: Synthetic peptide
  XENP020717 vhCDR2
FISYDGNNKYYADSVKG

SEQ ID NO: 38522 - protein, 9 aa, Artificial Sequence
  Description of Artificial Sequence: Synthetic peptide
  XENP020717 vhCDR3
TGWLGPFDY

SEQ ID NO: 38523 - protein, 480 aa, Artificial Sequence; identical to SEQ ID NO: 23581
  Description of Artificial Sequence: Synthetic polypeptide
  XENP020717 ipilimumab_H3_L0.22-1G6_L1.194_H1.279 M428L/N434S scFv-Fc Heavy Chain

SEQ ID NO: 38524 - protein, 107 aa, Artificial Sequence; identical to SEQ ID NO: 10999
  Description of Artificial Sequence: Synthetic polypeptide
  VH of XENP020717

SEQ ID NO: 38525 - protein, 122 aa, Artificial Sequence; identical to SEQ ID NO: 10908
  Description of Artificial Sequence: Synthetic polypeptide
  VL of XENP020717

SEQ ID NO: 38526 - protein, 231 aa, Artificial Sequence; identical to SEQ ID NO: 21572
  Description of Artificial Sequence: Synthetic polypeptide
  Fc chain of XENP020717

SEQ ID NO: 38527 - protein, 11 aa, Artificial Sequence
  Description of Artificial Sequence: Synthetic peptide
  XENP020717 vhCDR1
RASQSVGNDVA

SEQ ID NO: 38528 - protein, 7 aa, Artificial Sequence
  Description of Artificial Sequence: Synthetic peptide
  XENP020717 vhCDR2
YASHRYT

SEQ ID NO: 38529 - protein, 9 aa, Artificial Sequence
  Description of Artificial Sequence: Synthetic peptide
  XENP020717 vhCDR3
QQDFSSPRT

SEQ ID NO: 38530 - protein, 5 aa, Artificial Sequence
  Description of Artificial Sequence: Synthetic peptide
  XENP020717 vlCDR1
NYWMN

SEQ ID NO: 38531 - protein, 19 aa, Artificial Sequence
  Description of Artificial Sequence: Synthetic peptide
  XENP020717 vlCDR2
EIRLYSNNYATHYAESVKG

SEQ ID NO: 38532 - protein, 11 aa, Artificial Sequence
  Description of Artificial Sequence: Synthetic peptide
  XENP020717 vlCDR3
YYGNYGGYFDV

SEQ ID NO: 38533 - protein, 215 aa, Artificial Sequence; identical to SEQ ID NO: 4504
  Description of Artificial Sequence: Synthetic polypeptide
  XENP020717 ipilimumab_H3_L0.22-1G6_L1.194_H1.279 M428L/N434S Light Chain

SEQ ID NO: 38534 - protein, 108 aa, Artificial Sequence; identical to SEQ ID NO: 1607
  Description of Artificial Sequence: Synthetic polypeptide
  VL of XENP020717

SEQ ID NO: 38535 - protein, 12 aa, Artificial Sequence
  Description of Artificial Sequence: Synthetic peptide
  XENP020717 vlCDR1
RASQSVSSSYLA

SEQ ID NO: 38536 - protein, 7 aa, Artificial Sequence
  Description of Artificial Sequence: Synthetic peptide
  XENP020717 vlCDR2
GAFSRAT

SEQ ID NO: 38537 - protein, 9 aa, Artificial Sequence
  Description of Artificial Sequence: Synthetic peptide
  XENP020717 vlCDR3
QQYGSSPWT

SEQ ID NO: 38538 - protein, 449 aa, Artificial Sequence; identical to SEQ ID NO: 36247
  Description of Artificial Sequence: Synthetic polypeptide
  XENP022836 2E9_H1L1_Fab-[CTLA-4]_H3.23_L0.129_scFv HC-Fab

SEQ ID NO: 38539 - protein, 120 aa, Artificial Sequence; identical to SEQ ID NO: 11412
  Description of Artificial Sequence: Synthetic polypeptide
  VH of XENP022836

SEQ ID NO: 38540 - protein, 5 aa, Artificial Sequence
  Description of Artificial Sequence: Synthetic peptide
  XENP022836 vhCDR1
NYWLG

SEQ ID NO: 38541 - protein, 17 aa, Artificial Sequence
  Description of Artificial Sequence: Synthetic peptide
  XENP022836 vhCDR2
NFYPGSSNTYYNEKFQG

SEQ ID NO: 38542 - protein, 11 aa, Artificial Sequence
  Description of Artificial Sequence: Synthetic peptide
  XENP022836 vhCDR3
HYGTNYRYFDV

SEQ ID NO: 38543 - protein, 477 aa, Artificial Sequence; identical to SEQ ID NO: 21669
  Description of Artificial Sequence: Synthetic polypeptide
  XENP022836 2E9_H1L1_Fab-[CTLA-4]_H3.23_L0.129_scFv HC-scFV

SEQ ID NO: 38544 - protein, 118 aa, Artificial Sequence; identical to SEQ ID NO: 2632
  Description of Artificial Sequence: Synthetic polypeptide
  VH of XENP022836

SEQ ID NO: 38545 - protein, 108 aa, Artificial Sequence; identical to SEQ ID NO: 2768
  Description of Artificial Sequence: Synthetic polypeptide
  VL of XENP022836

SEQ ID NO: 38546 - protein, 231 aa, Artificial Sequence; identical to SEQ ID NO: 21532
  Description of Artificial Sequence: Synthetic polypeptide
  Fc chain of XENP022836

SEQ ID NO: 38547 - protein, 5 aa, Artificial Sequence
  Description of Artificial Sequence: Synthetic peptide
  XENP022836 vhCDR1
SYTMH

SEQ ID NO: 38548 - protein, 17 aa, Artificial Sequence
  Description of Artificial Sequence: Synthetic peptide
  XENP022836 vhCDR2
FISYDGNYKYYADSVKG

SEQ ID NO: 38549 - protein, 9 aa, Artificial Sequence
  Description of Artificial Sequence: Synthetic peptide
  XENP022836 vhCDR3
GGHLGPFDL

SEQ ID NO: 38550 - protein, 12 aa, Artificial Sequence
  Description of Artificial Sequence: Synthetic peptide
  XENP022836 vlCDR1
RASQSVGSSYLA

SEQ ID NO: 38551 - protein, 7 aa, Artificial Sequence
  Description of Artificial Sequence: Synthetic peptide
  XENP022836 vlCDR2
GASSRAT

SEQ ID NO: 38552 - protein, 9 aa, Artificial Sequence
  Description of Artificial Sequence: Synthetic peptide
  XENP022836 vlCDR3
QQYGSSPWT

SEQ ID NO: 38553 - protein, 214 aa, Artificial Sequence; identical to SEQ ID NO: 17080
  Description of Artificial Sequence: Synthetic polypeptide
  XENP022836 2E9_H1L1_Fab-[CTLA-4]_H3.23_L0.129_scFv Light Chain

SEQ ID NO: 38554 - protein, 107 aa, Artificial Sequence; identical to SEQ ID NO: 11413
  Description of Artificial Sequence: Synthetic polypeptide
  VL of XENP022836

SEQ ID NO: 38555 - protein, 11 aa, Artificial Sequence
  Description of Artificial Sequence: Synthetic peptide
  XENP022836 vlCDR1
RASQSVSNDVA

SEQ ID NO: 38556 - protein, 7 aa, Artificial Sequence
  Description of Artificial Sequence: Synthetic peptide
  XENP022836 vlCDR2
YASNRYT

SEQ ID NO: 38557 - protein, 9 aa, Artificial Sequence
  Description of Artificial Sequence: Synthetic peptide
  XENP022836 vlCDR3
QQDYSSPYT

SEQ ID NO: 38558 - protein, 447 aa, Artificial Sequence; identical to SEQ ID NO: 17235
  Description of Artificial Sequence: Synthetic polypeptide
  XENP020206 2A11_H1L2-1G6_L1.194_H1.279 Fab-Fc Heavy Chain

SEQ ID NO: 38559 - protein, 118 aa, Artificial Sequence; identical to SEQ ID NO: 17236
  Description of Artificial Sequence: Synthetic polypeptide
  VH of XENP020206

SEQ ID NO: 38560 - protein, 5 aa, Artificial Sequence
  Description of Artificial Sequence: Synthetic peptide
  XENP020206 vhCDR1
DYYMH

SEQ ID NO: 38561 - protein, 17 aa, Artificial Sequence
  Description of Artificial Sequence: Synthetic peptide
  XENP020206 vhCDR2
WIDPENGDTEYAPKFQG

SEQ ID NO: 38562 - protein, 9 aa, Artificial Sequence
  Description of Artificial Sequence: Synthetic peptide
  XENP020206 vhCDR3
RGVRQALDY

SEQ ID NO: 38563 - protein, 480 aa, Artificial Sequence; identical to SEQ ID NO: 23221
  Description of Artificial Sequence: Synthetic polypeptide
  XENP020206 2A11_H1L2-1G6_L1.194_H1.279 scFv-Fc Heavy Chain

SEQ ID NO: 38564 - protein, 107 aa, Artificial Sequence; identical to SEQ ID NO: 10999
  Description of Artificial Sequence: Synthetic polypeptide
  VH of XENP020206

SEQ ID NO: 38565 - protein, 122 aa, Artificial Sequence; identical to SEQ ID NO: 10908
  Description of Artificial Sequence: Synthetic polypeptide
  VL of XENP020206

SEQ ID NO: 38566 - protein, 231 aa, Artificial Sequence; identical to SEQ ID NO: 21532
  Description of Artificial Sequence: Synthetic polypeptide
  Fc chain of XENP020206

SEQ ID NO: 38567 - protein, 11 aa, Artificial Sequence
  Description of Artificial Sequence: Synthetic peptide
  XENP020206 vhCDR1
RASQSVGNDVA

SEQ ID NO: 38568 - protein, 7 aa, Artificial Sequence
  Description of Artificial Sequence: Synthetic peptide
  XENP020206 vhCDR2
YASHRYT

SEQ ID NO: 38569 - protein, 9 aa, Artificial Sequence
  Description of Artificial Sequence: Synthetic peptide
  XENP020206 vhCDR3
QQDFSSPRT

SEQ ID NO: 38570 - protein, 5 aa, Artificial Sequence
  Description of Artificial Sequence: Synthetic peptide
  XENP020206 vlCDR1
NYWMN

SEQ ID NO: 38571 - protein, 19 aa, Artificial Sequence
  Description of Artificial Sequence: Synthetic peptide
  XENP020206 vlCDR2
EIRLYSNNYATHYAESVKG

SEQ ID NO: 38572 - protein, 11 aa, Artificial Sequence
  Description of Artificial Sequence: Synthetic peptide
  XENP020206 vlCDR3
YYGNYGGYFDV

SEQ ID NO: 38573 - protein, 214 aa, Artificial Sequence; identical to SEQ ID NO: 17250
  Description of Artificial Sequence: Synthetic polypeptide
  XENP020206 2A11_H1L2-1G6_L1.194_H1.279 Light Chain

SEQ ID NO: 38574 - protein, 107 aa, Artificial Sequence; identical to SEQ ID NO: 17251
  Description of Artificial Sequence: Synthetic polypeptide
  VL of XENP020206

SEQ ID NO: 38575 - protein, 11 aa, Artificial Sequence
  Description of Artificial Sequence: Synthetic peptide
  XENP020206 vlCDR1
QASQDIGNYLN

SEQ ID NO: 38576 - protein, 7 aa, Artificial Sequence
  Description of Artificial Sequence: Synthetic peptide
  XENP020206 vlCDR2
YTSRLHS

SEQ ID NO: 38577 - protein, 9 aa, Artificial Sequence
  Description of Artificial Sequence: Synthetic peptide
  XENP020206 vlCDR3
QQGNTLPYT

SEQ ID NO: 38578 - protein, 447 aa, Artificial Sequence; identical to SEQ ID NO: 17235
  Description of Artificial Sequence: Synthetic polypeptide
  XENP021582 2A11_H1_L2.91_Fab-1G6_L1.194_H1.279 Fab-Fc Heavy Chain

SEQ ID NO: 38579 - protein, 118 aa, Artificial Sequence; identical to SEQ ID NO: 17236
  Description of Artificial Sequence: Synthetic polypeptide
  VH of XENP021582

SEQ ID NO: 38580 - protein, 5 aa, Artificial Sequence
  Description of Artificial Sequence: Synthetic peptide
  XENP021582 vhCDR1
DYYMH

SEQ ID NO: 38581 - protein, 17 aa, Artificial Sequence
  Description of Artificial Sequence: Synthetic peptide
  XENP021582 vhCDR2
WIDPENGDTEYAPKFQG

SEQ ID NO: 38582 - protein, 9 aa, Artificial Sequence
  Description of Artificial Sequence: Synthetic peptide
  XENP021582 vhCDR3
RGVRQALDY

SEQ ID NO: 38583 - protein, 480 aa, Artificial Sequence; identical to SEQ ID NO: 23221
  Description of Artificial Sequence: Synthetic polypeptide
  XENP021582 2A11_H1_L2.91_Fab-1G6_L1.194_H1.279 scFv-Fc Heavy Chain

SEQ ID NO: 38584 - protein, 107 aa, Artificial Sequence; identical to SEQ ID NO: 10999
  Description of Artificial Sequence: Synthetic polypeptide
  VH of XENP021582

SEQ ID NO: 38585 - protein, 122 aa, Artificial Sequence; identical to SEQ ID NO: 10908
  Description of Artificial Sequence: Synthetic polypeptide
  VL of XENP021582

SEQ ID NO: 38586 - protein, 231 aa, Artificial Sequence; identical to SEQ ID NO: 21532
  Description of Artificial Sequence: Synthetic polypeptide
  Fc chain of XENP021582

SEQ ID NO: 38587 - protein, 11 aa, Artificial Sequence
  Description of Artificial Sequence: Synthetic peptide
  XENP021582 vhCDR1
RASQSVGNDVA

SEQ ID NO: 38588 - protein, 7 aa, Artificial Sequence
  Description of Artificial Sequence: Synthetic peptide
  XENP021582 vhCDR2
YASHRYT

SEQ ID NO: 38589 - protein, 9 aa, Artificial Sequence
  Description of Artificial Sequence: Synthetic peptide
  XENP021582 vhCDR3
QQDFSSPRT

SEQ ID NO: 38590 - protein, 5 aa, Artificial Sequence
  Description of Artificial Sequence: Synthetic peptide
  XENP021582 vlCDR1
NYWMN

SEQ ID NO: 38591 - protein, 19 aa, Artificial Sequence
  Description of Artificial Sequence: Synthetic peptide
  XENP021582 vlCDR2
EIRLYSNNYATHYAESVKG

SEQ ID NO: 38592 - protein, 11 aa, Artificial Sequence
  Description of Artificial Sequence: Synthetic peptide
  XENP021582 vlCDR3
YYGNYGGYFDV

SEQ ID NO: 38593 - protein, 214 aa, Artificial Sequence; identical to SEQ ID NO: 24470
  Description of Artificial Sequence: Synthetic polypeptide
  XENP021582 2A11_H1_L2.91_Fab-1G6_L1.194_H1.279 Light Chain

SEQ ID NO: 38594 - protein, 107 aa, Artificial Sequence; identical to SEQ ID NO: 24471
  Description of Artificial Sequence: Synthetic polypeptide
  VL of XENP021582

SEQ ID NO: 38595 - protein, 11 aa, Artificial Sequence
  Description of Artificial Sequence: Synthetic peptide
  XENP021582 vlCDR1
QASQDIGNYLN

SEQ ID NO: 38596 - protein, 7 aa, Artificial Sequence
  Description of Artificial Sequence: Synthetic peptide
  XENP021582 vlCDR2
YTSRLHS

SEQ ID NO: 38597 - protein, 9 aa, Artificial Sequence
  Description of Artificial Sequence: Synthetic peptide
  XENP021582 vlCDR3
QQGNTLPYT

SEQ ID NO: 38598 - protein, 447 aa, Artificial Sequence; identical to SEQ ID NO: 17235
  Description of Artificial Sequence: Synthetic polypeptide
  XENP021584 2A11_H1_L2.93_Fab-1G6_L1.194_H1.279 Fab-Fc Heavy Chain

SEQ ID NO: 38599 - protein, 118 aa, Artificial Sequence; identical to SEQ ID NO: 17236
  Description of Artificial Sequence: Synthetic polypeptide
  VH of XENP021584

SEQ ID NO: 38600 - protein, 5 aa, Artificial Sequence
  Description of Artificial Sequence: Synthetic peptide
  XENP021584 vhCDR1
DYYMH

SEQ ID NO: 38601 - protein, 17 aa, Artificial Sequence
  Description of Artificial Sequence: Synthetic peptide
  XENP021584 vhCDR2
WIDPENGDTEYAPKFQG

SEQ ID NO: 38602 - protein, 9 aa, Artificial Sequence
  Description of Artificial Sequence: Synthetic peptide
  XENP021584 vhCDR3
RGVRQALDY

SEQ ID NO: 38603 - protein, 480 aa, Artificial Sequence; identical to SEQ ID NO: 23221
  Description of Artificial Sequence: Synthetic polypeptide
  XENP021584 2A11_H1_L2.93_Fab-1G6_L1.194_H1.279 scFv-Fc Heavy Chain

SEQ ID NO: 38604 - protein, 107 aa, Artificial Sequence; identical to SEQ ID NO: 10999
  Description of Artificial Sequence: Synthetic polypeptide
  VH of XENP021584

SEQ ID NO: 38605 - protein, 122 aa, Artificial Sequence; identical to SEQ ID NO: 10908
  Description of Artificial Sequence: Synthetic polypeptide
  VL of XENP021584

SEQ ID NO: 38606 - protein, 231 aa, Artificial Sequence; identical to SEQ ID NO: 21532
  Description of Artificial Sequence: Synthetic polypeptide
  Fc chain of XENP021584

SEQ ID NO: 38607 - protein, 11 aa, Artificial Sequence
  Description of Artificial Sequence: Synthetic peptide
  XENP021584 vhCDR1
RASQSVGNDVA

SEQ ID NO: 38608 - protein, 7 aa, Artificial Sequence
  Description of Artificial Sequence: Synthetic peptide
  XENP021584 vhCDR2
YASHRYT

SEQ ID NO: 38609 - protein, 9 aa, Artificial Sequence
  Description of Artificial Sequence: Synthetic peptide
  XENP021584 vhCDR3
QQDFSSPRT

SEQ ID NO: 38610 - protein, 5 aa, Artificial Sequence
  Description of Artificial Sequence: Synthetic peptide
  XENP021584 vlCDR1
NYWMN

SEQ ID NO: 38611 - protein, 19 aa, Artificial Sequence
  Description of Artificial Sequence: Synthetic peptide
  XENP021584 vlCDR2
EIRLYSNNYATHYAESVKG

SEQ ID NO: 38612 - protein, 11 aa, Artificial Sequence
  Description of Artificial Sequence: Synthetic peptide
  XENP021584 vlCDR3
YYGNYGGYFDV

SEQ ID NO: 38613 - protein, 214 aa, Artificial Sequence; identical to SEQ ID NO: 24510
  Description of Artificial Sequence: Synthetic polypeptide
  XENP021584 2A11_H1_L2.93_Fab-1G6_L1.194_H1.279 Light Chain

SEQ ID NO: 38614 - protein, 107 aa, Artificial Sequence; identical to SEQ ID NO: 24511
  Description of Artificial Sequence: Synthetic polypeptide
  VL of XENP021584

SEQ ID NO: 38615 - protein, 11 aa, Artificial Sequence
  Description of Artificial Sequence: Synthetic peptide
  XENP021584 vlCDR1
QASQDIGNYLN

SEQ ID NO: 38616 - protein, 7 aa, Artificial Sequence
  Description of Artificial Sequence: Synthetic peptide
  XENP021584 vlCDR2
YTSRLHS

SEQ ID NO: 38617 - protein, 9 aa, Artificial Sequence
  Description of Artificial Sequence: Synthetic peptide
  XENP021584 vlCDR3
QQGNTLPYT

SEQ ID NO: 38618 - protein, 447 aa, Artificial Sequence; identical to SEQ ID NO: 17235
  Description of Artificial Sequence: Synthetic polypeptide
  XENP021588 2A11_H1_L2.97_Fab-1G6_L1.194_H1.279 Fab-Fc Heavy Chain

SEQ ID NO: 38619 - protein, 118 aa, Artificial Sequence; identical to SEQ ID NO: 17236
  Description of Artificial Sequence: Synthetic polypeptide
  VH of XENP021588

SEQ ID NO: 38620 - protein, 5 aa, Artificial Sequence
  Description of Artificial Sequence: Synthetic peptide
  XENP021588 vhCDR1
DYYMH

SEQ ID NO: 38621 - protein, 17 aa, Artificial Sequence
  Description of Artificial Sequence: Synthetic peptide
  XENP021588 vhCDR2
WIDPENGDTEYAPKFQG

SEQ ID NO: 38622 - protein, 9 aa, Artificial Sequence
  Description of Artificial Sequence: Synthetic peptide
  XENP021588 vhCDR3
RGVRQALDY

SEQ ID NO: 38623 - protein, 480 aa, Artificial Sequence; identical to SEQ ID NO: 23221
  Description of Artificial Sequence: Synthetic polypeptide
  XENP021588 2A11_H1_L2.97_Fab-1G6_L1.194_H1.279 scFv-Fc Heavy Chain

SEQ ID NO: 38624 - protein, 107 aa, Artificial Sequence; identical to SEQ ID NO: 10999
  Description of Artificial Sequence: Synthetic polypeptide
  VH of XENP021588

SEQ ID NO: 38625 - protein, 122 aa, Artificial Sequence; identical to SEQ ID NO: 10908
  Description of Artificial Sequence: Synthetic polypeptide
  VL of XENP021588

SEQ ID NO: 38626 - protein, 231 aa, Artificial Sequence; identical to SEQ ID NO: 21532
  Description of Artificial Sequence: Synthetic polypeptide
  Fc chain of XENP021588

SEQ ID NO: 38627 - protein, 11 aa, Artificial Sequence
  Description of Artificial Sequence: Synthetic peptide
  XENP021588 vhCDR1
RASQSVGNDVA

SEQ ID NO: 38628 - protein, 7 aa, Artificial Sequence
  Description of Artificial Sequence: Synthetic peptide
  XENP021588 vhCDR2
YASHRYT

SEQ ID NO: 38629 - protein, 9 aa, Artificial Sequence
  Description of Artificial Sequence: Synthetic peptide
  XENP021588 vhCDR3
QQDFSSPRT

SEQ ID NO: 38630 - protein, 5 aa, Artificial Sequence
  Description of Artificial Sequence: Synthetic peptide
  XENP021588 vlCDR1
NYWMN

SEQ ID NO: 38631 - protein, 19 aa, Artificial Sequence
  Description of Artificial Sequence: Synthetic peptide
  XENP021588 vlCDR2
EIRLYSNNYATHYAESVKG

SEQ ID NO: 38632 - protein, 11 aa, Artificial Sequence
  Description of Artificial Sequence: Synthetic peptide
  XENP021588 vlCDR3
YYGNYGGYFDV

SEQ ID NO: 38633 - protein, 214 aa, Artificial Sequence; identical to SEQ ID NO: 24590
  Description of Artificial Sequence: Synthetic polypeptide
  XENP021588 2A11_H1_L2.97_Fab-1G6_L1.194_H1.279 Light Chain

SEQ ID NO: 38634 - protein, 107 aa, Artificial Sequence; identical to SEQ ID NO: 24591
  Description of Artificial Sequence: Synthetic polypeptide
  VL of XENP021588

SEQ ID NO: 38635 - protein, 11 aa, Artificial Sequence
  Description of Artificial Sequence: Synthetic peptide
  XENP021588 vlCDR1
QASQDIGNYLN

SEQ ID NO: 38636 - protein, 7 aa, Artificial Sequence
  Description of Artificial Sequence: Synthetic peptide
  XENP021588 vlCDR2
YTSRLHS

SEQ ID NO: 38637 - protein, 9 aa, Artificial Sequence
  Description of Artificial Sequence: Synthetic peptide
  XENP021588 vlCDR3
QQGNTLPYT

SEQ ID NO: 38638 - protein, 447 aa, Artificial Sequence; identical to SEQ ID NO: 17235
  Description of Artificial Sequence: Synthetic polypeptide
  XENP022123 2A11_H1_L2.122_Fab-1G6_L1.194_H1.279 Fab-Fc Heavy Chain

SEQ ID NO: 38639 - protein, 118 aa, Artificial Sequence; identical to SEQ ID NO: 17236
  Description of Artificial Sequence: Synthetic polypeptide
  VH of XENP022123

SEQ ID NO: 38640 - protein, 5 aa, Artificial Sequence
  Description of Artificial Sequence: Synthetic peptide
  XENP022123 vhCDR1
DYYMH

SEQ ID NO: 38641 - protein, 17 aa, Artificial Sequence
  Description of Artificial Sequence: Synthetic peptide
  XENP022123 vhCDR2
WIDPENGDTEYAPKFQG

SEQ ID NO: 38642 - protein, 9 aa, Artificial Sequence
  Description of Artificial Sequence: Synthetic peptide
  XENP022123 vhCDR3
RGVRQALDY

SEQ ID NO: 38643 - protein, 480 aa, Artificial Sequence; identical to SEQ ID NO: 23221
  Description of Artificial Sequence: Synthetic polypeptide
  XENP022123 2A11_H1_L2.122_Fab-1G6_L1.194_H1.279 scFv-Fc Heavy Chain

SEQ ID NO: 38644 - protein, 107 aa, Artificial Sequence; identical to SEQ ID NO: 10999
  Description of Artificial Sequence: Synthetic polypeptide
  VH of XENP022123

SEQ ID NO: 38645 - protein, 122 aa, Artificial Sequence; identical to SEQ ID NO: 10908
  Description of Artificial Sequence: Synthetic polypeptide
  VL of XENP022123

SEQ ID NO: 38646 - protein, 231 aa, Artificial Sequence; identical to SEQ ID NO: 21532
  Description of Artificial Sequence: Synthetic polypeptide
  Fc chain of XENP022123

SEQ ID NO: 38647 - protein, 11 aa, Artificial Sequence
  Description of Artificial Sequence: Synthetic peptide
  XENP022123 vhCDR1
RASQSVGNDVA

SEQ ID NO: 38648 - protein, 7 aa, Artificial Sequence
  Description of Artificial Sequence: Synthetic peptide
  XENP022123 vhCDR2
YASHRYT

SEQ ID NO: 38649 - protein, 9 aa, Artificial Sequence
  Description of Artificial Sequence: Synthetic peptide
  XENP022123 vhCDR3
QQDFSSPRT

SEQ ID NO: 38650 - protein, 5 aa, Artificial Sequence
  Description of Artificial Sequence: Synthetic peptide
  XENP022123 vlCDR1
NYWMN

SEQ ID NO: 38651 - protein, 19 aa, Artificial Sequence
  Description of Artificial Sequence: Synthetic peptide
  XENP022123 vlCDR2
EIRLYSNNYATHYAESVKG

SEQ ID NO: 38652 - protein, 11 aa, Artificial Sequence
  Description of Artificial Sequence: Synthetic peptide
  XENP022123 vlCDR3
YYGNYGGYFDV

SEQ ID NO: 38653 - protein, 214 aa, Artificial Sequence; identical to SEQ ID NO: 24690
  Description of Artificial Sequence: Synthetic polypeptide
  XENP022123 2A11_H1_L2.122_Fab-1G6_L1.194_H1.279 Light Chain

SEQ ID NO: 38654 - protein, 107 aa, Artificial Sequence; identical to SEQ ID NO: 24691
  Description of Artificial Sequence: Synthetic polypeptide
  VL of XENP022123

SEQ ID NO: 38655 - protein, 11 aa, Artificial Sequence
  Description of Artificial Sequence: Synthetic peptide
  XENP022123 vlCDR1
QASQDIGNYLN

SEQ ID NO: 38656 - protein, 7 aa, Artificial Sequence
  Description of Artificial Sequence: Synthetic peptide
  XENP022123 vlCDR2
YTSRLHS

SEQ ID NO: 38657 - protein, 9 aa, Artificial Sequence
  Description of Artificial Sequence: Synthetic peptide
  XENP022123 vlCDR3
QQGNTLPYT

SEQ ID NO: 38658 - protein, 447 aa, Artificial Sequence; identical to SEQ ID NO: 17235
  Description of Artificial Sequence: Synthetic polypeptide
  XENP022124 2A11_H1_L2.123_Fab-1G6_L1.194_H1.279 Fab-Fc Heavy Chain

SEQ ID NO: 38659 - protein, 118 aa, Artificial Sequence; identical to SEQ ID NO: 17236
  Description of Artificial Sequence: Synthetic polypeptide
  VH of XENP022124

SEQ ID NO: 38660 - protein, 5 aa, Artificial Sequence
  Description of Artificial Sequence: Synthetic peptide
  XENP022124 vhCDR1
DYYMH

SEQ ID NO: 38661 - protein, 17 aa, Artificial Sequence
  Description of Artificial Sequence: Synthetic peptide
  XENP022124 vhCDR2
WIDPENGDTEYAPKFQG

SEQ ID NO: 38662 - protein, 9 aa, Artificial Sequence
  Description of Artificial Sequence: Synthetic peptide
  XENP022124 vhCDR3
RGVRQALDY

SEQ ID NO: 38663 - protein, 480 aa, Artificial Sequence; identical to SEQ ID NO: 23221
  Description of Artificial Sequence: Synthetic polypeptide
  XENP022124 2A11_H1_L2.123_Fab-1G6_L1.194_H1.279 scFv-Fc Heavy Chain

SEQ ID NO: 38664 - protein, 107 aa, Artificial Sequence; identical to SEQ ID NO: 10999
  Description of Artificial Sequence: Synthetic polypeptide
  VH of XENP022124

SEQ ID NO: 38665 - protein, 122 aa, Artificial Sequence; identical to SEQ ID NO: 10908
  Description of Artificial Sequence: Synthetic polypeptide
  VL of XENP022124

SEQ ID NO: 38666 - protein, 231 aa, Artificial Sequence; identical to SEQ ID NO: 21532
  Description of Artificial Sequence: Synthetic polypeptide
  Fc chain of XENP022124

SEQ ID NO: 38667 - protein, 11 aa, Artificial Sequence
  Description of Artificial Sequence: Synthetic peptide
  XENP022124 vhCDR1
RASQSVGNDVA

SEQ ID NO: 38668 - protein, 7 aa, Artificial Sequence
  Description of Artificial Sequence: Synthetic peptide
  XENP022124 vhCDR2
YASHRYT

SEQ ID NO: 38669 - protein, 9 aa, Artificial Sequence
  Description of Artificial Sequence: Synthetic peptide
  XENP022124 vhCDR3
QQDFSSPRT

SEQ ID NO: 38670 - protein, 5 aa, Artificial Sequence
  Description of Artificial Sequence: Synthetic peptide
  XENP022124 vlCDR1
NYWMN

SEQ ID NO: 38671 - protein, 19 aa, Artificial Sequence
  Description of Artificial Sequence: Synthetic peptide
  XENP022124 vlCDR2
EIRLYSNNYATHYAESVKG

SEQ ID NO: 38672 - protein, 11 aa, Artificial Sequence
  Description of Artificial Sequence: Synthetic peptide
  XENP022124 vlCDR3
YYGNYGGYFDV

SEQ ID NO: 38673 - protein, 214 aa, Artificial Sequence; identical to SEQ ID NO: 24710
  Description of Artificial Sequence: Synthetic polypeptide
  XENP022124 2A11_H1_L2.123_Fab-1G6_L1.194_H1.279 Light Chain

SEQ ID NO: 38674 - protein, 107 aa, Artificial Sequence; identical to SEQ ID NO: 24711
  Description of Artificial Sequence: Synthetic polypeptide
  VL of XENP022124

SEQ ID NO: 38675 - protein, 11 aa, Artificial Sequence
  Description of Artificial Sequence: Synthetic peptide
  XENP022124 vlCDR1
QASQDIGNYLN

SEQ ID NO: 38676 - protein, 7 aa, Artificial Sequence
  Description of Artificial Sequence: Synthetic peptide
  XENP022124 vlCDR2
YTSRLHS

SEQ ID NO: 38677 - protein, 9 aa, Artificial Sequence
  Description of Artificial Sequence: Synthetic peptide
  XENP022124 vlCDR3
QQGNTLPYT

SEQ ID NO: 38678 - protein, 447 aa, Artificial Sequence; identical to SEQ ID NO: 17235
  Description of Artificial Sequence: Synthetic polypeptide
  XENP022125 2A11_H1_L2.124_Fab-1G6_L1.194_H1.279 Fab-Fc Heavy Chain

SEQ ID NO: 38679 - protein, 118 aa, Artificial Sequence; identical to SEQ ID NO: 17236
  Description of Artificial Sequence: Synthetic polypeptide
  VH of XENP022125

SEQ ID NO: 38680 - protein, 5 aa, Artificial Sequence
  Description of Artificial Sequence: Synthetic peptide
  XENP022125 vhCDR1
DYYMH

SEQ ID NO: 38681 - protein, 17 aa, Artificial Sequence
  Description of Artificial Sequence: Synthetic peptide
  XENP022125 vhCDR2
WIDPENGDTEYAPKFQG

SEQ ID NO: 38682 - protein, 9 aa, Artificial Sequence
  Description of Artificial Sequence: Synthetic peptide
  XENP022125 vhCDR3
RGVRQALDY

SEQ ID NO: 38683 - protein, 480 aa, Artificial Sequence; identical to SEQ ID NO: 23221
  Description of Artificial Sequence: Synthetic polypeptide
  XENP022125 2A11_H1_L2.124_Fab-1G6_L1.194_H1.279 scFv-Fc Heavy Chain

SEQ ID NO: 38684 - protein, 107 aa, Artificial Sequence; identical to SEQ ID NO: 10999
  Description of Artificial Sequence: Synthetic polypeptide
  VH of XENP022125

SEQ ID NO: 38685 - protein, 122 aa, Artificial Sequence; identical to SEQ ID NO: 10908
  Description of Artificial Sequence: Synthetic polypeptide
  VL of XENP022125

SEQ ID NO: 38686 - protein, 231 aa, Artificial Sequence; identical to SEQ ID NO: 21532
  Description of Artificial Sequence: Synthetic polypeptide
  Fc chain of XENP022125

SEQ ID NO: 38687 - protein, 11 aa, Artificial Sequence
  Description of Artificial Sequence: Synthetic peptide
  XENP022125 vhCDR1
RASQSVGNDVA

SEQ ID NO: 38688 - protein, 7 aa, Artificial Sequence
  Description of Artificial Sequence: Synthetic peptide
  XENP022125 vhCDR2
YASHRYT

SEQ ID NO: 38689 - protein, 9 aa, Artificial Sequence
  Description of Artificial Sequence: Synthetic peptide
  XENP022125 vhCDR3
QQDFSSPRT

SEQ ID NO: 38690 - protein, 5 aa, Artificial Sequence
  Description of Artificial Sequence: Synthetic peptide
  XENP022125 vlCDR1
NYWMN

SEQ ID NO: 38691 - protein, 19 aa, Artificial Sequence
  Description of Artificial Sequence: Synthetic peptide
  XENP022125 vlCDR2
EIRLYSNNYATHYAESVKG

SEQ ID NO: 38692 - protein, 11 aa, Artificial Sequence
  Description of Artificial Sequence: Synthetic peptide
  XENP022125 vlCDR3
YYGNYGGYFDV

SEQ ID NO: 38693 - protein, 214 aa, Artificial Sequence; identical to SEQ ID NO: 24730
  Description of Artificial Sequence: Synthetic polypeptide
  XENP022125 2A11_H1_L2.124_Fab-1G6_L1.194_H1.279 Light Chain

SEQ ID NO: 38694 - protein, 107 aa, Artificial Sequence; identical to SEQ ID NO: 24731
  Description of Artificial Sequence: Synthetic polypeptide
  VL of XENP022125

SEQ ID NO: 38695 - protein, 11 aa, Artificial Sequence
  Description of Artificial Sequence: Synthetic peptide
  XENP022125 vlCDR1
QASQDIGNYLN

SEQ ID NO: 38696 - protein, 7 aa, Artificial Sequence
  Description of Artificial Sequence: Synthetic peptide
  XENP022125 vlCDR2
YTSRLHS

SEQ ID NO: 38697 - protein, 9 aa, Artificial Sequence
  Description of Artificial Sequence: Synthetic peptide
  XENP022125 vlCDR3
QQGNTLPYT

SEQ ID NO: 38698 - protein, 450 aa, Artificial Sequence; identical to SEQ ID NO: 22484
  Description of Artificial Sequence: Synthetic polypeptide
  XENP022604 7G8_H3.30_L1.34-1G6_L1.194_H1.279 Fab-Fc Heavy Chain

SEQ ID NO: 38699 - protein, 121 aa, Artificial Sequence; identical to SEQ ID NO: 22485
  Description of Artificial Sequence: Synthetic polypeptide
  VH of XENP022604

SEQ ID NO: 38700 - protein, 5 aa, Artificial Sequence
  Description of Artificial Sequence: Synthetic peptide
  XENP022604 vhCDR1
DAWMS

SEQ ID NO: 38701 - protein, 19 aa, Artificial Sequence
  Description of Artificial Sequence: Synthetic peptide
  XENP022604 vhCDR2
EISTKANNHATYYAESVKG

SEQ ID NO: 38702 - protein, 10 aa, Artificial Sequence
  Description of Artificial Sequence: Synthetic peptide
  XENP022604 vhCDR3
LATWDWYFDV

SEQ ID NO: 38703 - protein, 480 aa, Artificial Sequence; identical to SEQ ID NO: 23221
  Description of Artificial Sequence: Synthetic polypeptide
  XENP022604 7G8_H3.30_L1.34-1G6_L1.194_H1.279 scFv-Fc Heavy Chain

SEQ ID NO: 38704 - protein, 107 aa, Artificial Sequence; identical to SEQ ID NO: 10999
  Description of Artificial Sequence: Synthetic polypeptide
  VH of XENP022604

SEQ ID NO: 38705 - protein, 122 aa, Artificial Sequence; identical to SEQ ID NO: 10908
  Description of Artificial Sequence: Synthetic polypeptide
  VL of XENP022604

SEQ ID NO: 38706 - protein, 231 aa, Artificial Sequence; identical to SEQ ID NO: 21532
  Description of Artificial Sequence: Synthetic polypeptide
  Fc chain of XENP022604

SEQ ID NO: 38707 - protein, 11 aa, Artificial Sequence
  Description of Artificial Sequence: Synthetic peptide
  XENP022604 vhCDR1
RASQSVGNDVA

SEQ ID NO: 38708 - protein, 7 aa, Artificial Sequence
  Description of Artificial Sequence: Synthetic peptide
  XENP022604 vhCDR2
YASHRYT

SEQ ID NO: 38709 - protein, 9 aa, Artificial Sequence
  Description of Artificial Sequence: Synthetic peptide
  XENP022604 vhCDR3
QQDFSSPRT

SEQ ID NO: 38710 - protein, 5 aa, Artificial Sequence
  Description of Artificial Sequence: Synthetic peptide
  XENP022604 vlCDR1
NYWMN

SEQ ID NO: 38711 - protein, 19 aa, Artificial Sequence
  Description of Artificial Sequence: Synthetic peptide
  XENP022604 vlCDR2
EIRLYSNNYATHYAESVKG

SEQ ID NO: 38712 - protein, 11 aa, Artificial Sequence
  Description of Artificial Sequence: Synthetic peptide
  XENP022604 vlCDR3
YYGNYGGYFDV

SEQ ID NO: 38713 - protein, 218 aa, Artificial Sequence; identical to SEQ ID NO: 22599
  Description of Artificial Sequence: Synthetic polypeptide
  XENP022604 7G8_H3.30_L1.34-1G6_L1.194_H1.279 Light Chain

SEQ ID NO: 38714 - protein, 111 aa, Artificial Sequence; identical to SEQ ID NO: 22600
  Description of Artificial Sequence: Synthetic polypeptide
  VL of XENP022604

SEQ ID NO: 38715 - protein, 15 aa, Artificial Sequence
  Description of Artificial Sequence: Synthetic peptide
  XENP022604 vlCDR1
RASQSVDYDGDSYMN

SEQ ID NO: 38716 - protein, 7 aa, Artificial Sequence
  Description of Artificial Sequence: Synthetic peptide
  XENP022604 vlCDR2
AASELES

SEQ ID NO: 38717 - protein, 9 aa, Artificial Sequence
  Description of Artificial Sequence: Synthetic peptide
  XENP022604 vlCDR3
QQSNEDPFT

SEQ ID NO: 38718 - protein, 447 aa, Artificial Sequence; identical to SEQ ID NO: 22084
  Description of Artificial Sequence: Synthetic polypeptide
  XENP022672 2A11_H1.144_L2.142_Fab-1G6_L1.194_H1.279 Fab-Fc Heavy Chain

SEQ ID NO: 38719 - protein, 118 aa, Artificial Sequence; identical to SEQ ID NO: 22085
  Description of Artificial Sequence: Synthetic polypeptide
  VH of XENP022672

SEQ ID NO: 38720 - protein, 5 aa, Artificial Sequence
  Description of Artificial Sequence: Synthetic peptide
  XENP022672 vhCDR1
DYFMH

SEQ ID NO: 38721 - protein, 17 aa, Artificial Sequence
  Description of Artificial Sequence: Synthetic peptide
  XENP022672 vhCDR2
WIDPELGDTEYAPKFQG

SEQ ID NO: 38722 - protein, 9 aa, Artificial Sequence
  Description of Artificial Sequence: Synthetic peptide
  XENP022672 vhCDR3
RGVYQALDY

SEQ ID NO: 38723 - protein, 480 aa, Artificial Sequence; identical to SEQ ID NO: 23221
  Description of Artificial Sequence: Synthetic polypeptide
  XENP022672 2A11_H1.144_L2.142_Fab-1G6_L1.194_H1.279 scFv-Fc Heavy Chain

SEQ ID NO: 38724 - protein, 107 aa, Artificial Sequence; identical to SEQ ID NO: 10999
  Description of Artificial Sequence: Synthetic polypeptide
  VH of XENP022672

SEQ ID NO: 38725 - protein, 122 aa, Artificial Sequence; identical to SEQ ID NO: 10908
  Description of Artificial Sequence: Synthetic polypeptide
  VL of XENP022672

SEQ ID NO: 38726 - protein, 231 aa, Artificial Sequence; identical to SEQ ID NO: 21532
  Description of Artificial Sequence: Synthetic polypeptide
  Fc chain of XENP022672

SEQ ID NO: 38727 - protein, 11 aa, Artificial Sequence
  Description of Artificial Sequence: Synthetic peptide
  XENP022672 vhCDR1
RASQSVGNDVA

SEQ ID NO: 38728 - protein, 7 aa, Artificial Sequence
  Description of Artificial Sequence: Synthetic peptide
  XENP022672 vhCDR2
YASHRYT

SEQ ID NO: 38729 - protein, 9 aa, Artificial Sequence
  Description of Artificial Sequence: Synthetic peptide
  XENP022672 vhCDR3
QQDFSSPRT

SEQ ID NO: 38730 - protein, 5 aa, Artificial Sequence
  Description of Artificial Sequence: Synthetic peptide
  XENP022672 vlCDR1
NYWMN

SEQ ID NO: 38731 - protein, 19 aa, Artificial Sequence
  Description of Artificial Sequence: Synthetic peptide
  XENP022672 vlCDR2
EIRLYSNNYATHYAESVKG

SEQ ID NO: 38732 - protein, 11 aa, Artificial Sequence
  Description of Artificial Sequence: Synthetic peptide
  XENP022672 vlCDR3
YYGNYGGYFDV

SEQ ID NO: 38733 - protein, 214 aa, Artificial Sequence; identical to SEQ ID NO: 22279
  Description of Artificial Sequence: Synthetic polypeptide
  XENP022672 2A11_H1.144_L2.142_Fab-1G6_L1.194_H1.279 Light Chain

SEQ ID NO: 38734 - protein, 107 aa, Artificial Sequence; identical to SEQ ID NO: 22280
  Description of Artificial Sequence: Synthetic polypeptide
  VL of XENP022672

SEQ ID NO: 38735 - protein, 11 aa, Artificial Sequence
  Description of Artificial Sequence: Synthetic peptide
  XENP022672 vlCDR1
QASQDIGNYLN

SEQ ID NO: 38736 - protein, 7 aa, Artificial Sequence
  Description of Artificial Sequence: Synthetic peptide
  XENP022672 vlCDR2
FTSYLHS

SEQ ID NO: 38737 - protein, 9 aa, Artificial Sequence
  Description of Artificial Sequence: Synthetic peptide
  XENP022672 vlCDR3
QQGNTLPYT

SEQ ID NO: 38738 - protein, 450 aa, Artificial Sequence; identical to SEQ ID NO: 35607
  Description of Artificial Sequence: Synthetic polypeptide
  XENP022847 7G8_H3.30_L1.34_Fab-1G6_L1.194_H1.279_scFv M428L/N434S Fab-Fc Heavy Chain

SEQ ID NO: 38739 - protein, 121 aa, Artificial Sequence; identical to SEQ ID NO: 22485
  Description of Artificial Sequence: Synthetic polypeptide
  VH of XENP022847

SEQ ID NO: 38740 - protein, 5 aa, Artificial Sequence
  Description of Artificial Sequence: Synthetic peptide
  XENP022847 vhCDR1
DAWMS

SEQ ID NO: 38741 - protein, 19 aa, Artificial Sequence
  Description of Artificial Sequence: Synthetic peptide
  XENP022847 vhCDR2
EISTKANNHATYYAESVKG

SEQ ID NO: 38742 - protein, 10 aa, Artificial Sequence
  Description of Artificial Sequence: Synthetic peptide
  XENP022847 vhCDR3
LATWDWYFDV

SEQ ID NO: 38743 - protein, 480 aa, Artificial Sequence; identical to SEQ ID NO: 23581
  Description of Artificial Sequence: Synthetic polypeptide
  XENP022847 7G8_H3.30_L1.34_Fab-1G6_L1.194_H1.279_scFv M428L/N434S scFv-Fc Heavy Chain

SEQ ID NO: 38744 - protein, 107 aa, Artificial Sequence; identical to SEQ ID NO: 10999
  Description of Artificial Sequence: Synthetic polypeptide
  VH of XENP022847

SEQ ID NO: 38745 - protein, 122 aa, Artificial Sequence; identical to SEQ ID NO: 10908
  Description of Artificial Sequence: Synthetic polypeptide
  VL of XENP022847

SEQ ID NO: 38746 - protein, 231 aa, Artificial Sequence; identical to SEQ ID NO: 21572
  Description of Artificial Sequence: Synthetic polypeptide
  Fc chain of XENP022847

SEQ ID NO: 38747 - protein, 11 aa, Artificial Sequence
  Description of Artificial Sequence: Synthetic peptide
  XENP022847 vhCDR1
RASQSVGNDVA

SEQ ID NO: 38748 - protein, 7 aa, Artificial Sequence
  Description of Artificial Sequence: Synthetic peptide
  XENP022847 vhCDR2
YASHRYT

SEQ ID NO: 38749 - protein, 9 aa, Artificial Sequence
  Description of Artificial Sequence: Synthetic peptide
  XENP022847 vhCDR3
QQDFSSPRT

SEQ ID NO: 38750 - protein, 5 aa, Artificial Sequence
  Description of Artificial Sequence: Synthetic peptide
  XENP022847 vlCDR1
NYWMN

SEQ ID NO: 38751 - protein, 19 aa, Artificial Sequence
  Description of Artificial Sequence: Synthetic peptide
  XENP022847 vlCDR2
EIRLYSNNYATHYAESVKG

SEQ ID NO: 38752 - protein, 11 aa, Artificial Sequence
  Description of Artificial Sequence: Synthetic peptide
  XENP022847 vlCDR3
YYGNYGGYFDV

SEQ ID NO: 38753 - protein, 218 aa, Artificial Sequence; identical to SEQ ID NO: 22599
  Description of Artificial Sequence: Synthetic polypeptide
  XENP022847 7G8_H3.30_L1.34_Fab-1G6_L1.194_H1.279_scFv M428L/N434S Light Chain

SEQ ID NO: 38754 - protein, 111 aa, Artificial Sequence; identical to SEQ ID NO: 22600
  Description of Artificial Sequence: Synthetic polypeptide
  VL of XENP022847

SEQ ID NO: 38755 - protein, 15 aa, Artificial Sequence
  Description of Artificial Sequence: Synthetic peptide
  XENP022847 vlCDR1
RASQSVDYDGDSYMN

SEQ ID NO: 38756 - protein, 7 aa, Artificial Sequence
  Description of Artificial Sequence: Synthetic peptide
  XENP022847 vlCDR2
AASELES

SEQ ID NO: 38757 - protein, 9 aa, Artificial Sequence
  Description of Artificial Sequence: Synthetic peptide
  XENP022847 vlCDR3
QQSNEDPFT

SEQ ID NO: 38758 - protein, 447 aa, Artificial Sequence; identical to SEQ ID NO: 35647
  Description of Artificial Sequence: Synthetic polypeptide
  XENP022849 2A11_H1.144_L2.142_Fab-1G6_L1.194_H1.279_scFv M428L/N434S Fab-Fc Heavy Chain

SEQ ID NO: 38759 - protein, 118 aa, Artificial Sequence; identical to SEQ ID NO: 22085
  Description of Artificial Sequence: Synthetic polypeptide
  VH of XENP022849

SEQ ID NO: 38760 - protein, 5 aa, Artificial Sequence
  Description of Artificial Sequence: Synthetic peptide
  XENP022849 vhCDR1
DYFMH

SEQ ID NO: 38761 - protein, 17 aa, Artificial Sequence
  Description of Artificial Sequence: Synthetic peptide
  XENP022849 vhCDR2
WIDPELGDTEYAPKFQG

SEQ ID NO: 38762 - protein, 9 aa, Artificial Sequence
  Description of Artificial Sequence: Synthetic peptide
  XENP022849 vhCDR3
RGVYQALDY

SEQ ID NO: 38763 - protein, 480 aa, Artificial Sequence; identical to SEQ ID NO: 23581
  Description of Artificial Sequence: Synthetic polypeptide
  XENP022849 2A11_H1.144_L2.142_Fab-1G6_L1.194_H1.279_scFv M428L/N434S scFv-Fc Heavy Chain

SEQ ID NO: 38764 - protein, 107 aa, Artificial Sequence; identical to SEQ ID NO: 10999
  Description of Artificial Sequence: Synthetic polypeptide
  VH of XENP022849

SEQ ID NO: 38765 - protein, 122 aa, Artificial Sequence; identical to SEQ ID NO: 10908
  Description of Artificial Sequence: Synthetic polypeptide
  VL of XENP022849

SEQ ID NO: 38766 - protein, 231 aa, Artificial Sequence; identical to SEQ ID NO: 21572
  Description of Artificial Sequence: Synthetic polypeptide
  Fc chain of XENP022849

SEQ ID NO: 38767 - protein, 11 aa, Artificial Sequence
  Description of Artificial Sequence: Synthetic peptide
  XENP022849 vhCDR1
RASQSVGNDVA

SEQ ID NO: 38768 - protein, 7 aa, Artificial Sequence
  Description of Artificial Sequence: Synthetic peptide
  XENP022849 vhCDR2
YASHRYT

SEQ ID NO: 38769 - protein, 9 aa, Artificial Sequence
  Description of Artificial Sequence: Synthetic peptide
  XENP022849 vhCDR3
QQDFSSPRT

SEQ ID NO: 38770 - protein, 5 aa, Artificial Sequence
  Description of Artificial Sequence: Synthetic peptide
  XENP022849 vlCDR1
NYWMN

SEQ ID NO: 38771 - protein, 19 aa, Artificial Sequence
  Description of Artificial Sequence: Synthetic peptide
  XENP022849 vlCDR2
EIRLYSNNYATHYAESVKG

SEQ ID NO: 38772 - protein, 11 aa, Artificial Sequence
  Description of Artificial Sequence: Synthetic peptide
  XENP022849 vlCDR3
YYGNYGGYFDV

SEQ ID NO: 38773 - protein, 214 aa, Artificial Sequence; identical to SEQ ID NO: 22279
  Description of Artificial Sequence: Synthetic polypeptide
  XENP022849 2A11_H1.144_L2.142_Fab-1G6_L1.194_H1.279_scFv M428L/N434S Light Chain

SEQ ID NO: 38774 - protein, 107 aa, Artificial Sequence; identical to SEQ ID NO: 22280
  Description of Artificial Sequence: Synthetic polypeptide
  VL of XENP022849

SEQ ID NO: 38775 - protein, 11 aa, Artificial Sequence
  Description of Artificial Sequence: Synthetic peptide
  XENP022849 vlCDR1
QASQDIGNYLN

SEQ ID NO: 38776 - protein, 7 aa, Artificial Sequence
  Description of Artificial Sequence: Synthetic peptide
  XENP022849 vlCDR2
FTSYLHS

SEQ ID NO: 38777 - protein, 9 aa, Artificial Sequence
  Description of Artificial Sequence: Synthetic peptide
  XENP022849 vlCDR3
QQGNTLPYT

SEQ ID NO: 38778 - protein, 447 aa, Artificial Sequence; identical to SEQ ID NO: 22844
  Description of Artificial Sequence: Synthetic polypeptide
  XENP020895 9C6_H0L0-1G6_L1.194_H1.279 Fab-Fc Heavy Chain

SEQ ID NO: 38779 - protein, 118 aa, Artificial Sequence; identical to SEQ ID NO: 20936
  Description of Artificial Sequence: Synthetic polypeptide
  VH of XENP020895

SEQ ID NO: 38780 - protein, 5 aa, Artificial Sequence
  Description of Artificial Sequence: Synthetic peptide
  XENP020895 vhCDR1
GYGVN

SEQ ID NO: 38781 - protein, 16 aa, Artificial Sequence
  Description of Artificial Sequence: Synthetic peptide
  XENP020895 vhCDR2
MIWIDGSTDYNSALKS

SEQ ID NO: 38782 - protein, 10 aa, Artificial Sequence
  Description of Artificial Sequence: Synthetic peptide
  XENP020895 vhCDR3
DRPDGRAMDY

SEQ ID NO: 38783 - protein, 480 aa, Artificial Sequence; identical to SEQ ID NO: 23221
  Description of Artificial Sequence: Synthetic polypeptide
  XENP020895 9C6_H0L0-1G6_L1.194_H1.279 scFv-Fc Heavy Chain

SEQ ID NO: 38784 - protein, 107 aa, Artificial Sequence; identical to SEQ ID NO: 10999
  Description of Artificial Sequence: Synthetic polypeptide
  VH of XENP020895

SEQ ID NO: 38785 - protein, 122 aa, Artificial Sequence; identical to SEQ ID NO: 10908
  Description of Artificial Sequence: Synthetic polypeptide
  VL of XENP020895

SEQ ID NO: 38786 - protein, 231 aa, Artificial Sequence; identical to SEQ ID NO: 21532
  Description of Artificial Sequence: Synthetic polypeptide
  Fc chain of XENP020895

SEQ ID NO: 38787 - protein, 11 aa, Artificial Sequence
  Description of Artificial Sequence: Synthetic peptide
  XENP020895 vhCDR1
RASQSVGNDVA

SEQ ID NO: 38788 - protein, 7 aa, Artificial Sequence
  Description of Artificial Sequence: Synthetic peptide
  XENP020895 vhCDR2
YASHRYT

SEQ ID NO: 38789 - protein, 9 aa, Artificial Sequence
  Description of Artificial Sequence: Synthetic peptide
  XENP020895 vhCDR3
QQDFSSPRT

SEQ ID NO: 38790 - protein, 5 aa, Artificial Sequence
  Description of Artificial Sequence: Synthetic peptide
  XENP020895 vlCDR1
NYWMN

SEQ ID NO: 38791 - protein, 19 aa, Artificial Sequence
  Description of Artificial Sequence: Synthetic peptide
  XENP020895 vlCDR2
EIRLYSNNYATHYAESVKG

SEQ ID NO: 38792 - protein, 11 aa, Artificial Sequence
  Description of Artificial Sequence: Synthetic peptide
  XENP020895 vlCDR3
YYGNYGGYFDV

SEQ ID NO: 38793 - protein, 213 aa, Artificial Sequence; identical to SEQ ID NO: 20940
  Description of Artificial Sequence: Synthetic polypeptide
  XENP020895 9C6_H0L0-1G6_L1.194_H1.279 Light Chain

SEQ ID NO: 38794 - protein, 106 aa, Artificial Sequence; identical to SEQ ID NO: 20941
  Description of Artificial Sequence: Synthetic polypeptide
  VL of XENP020895

SEQ ID NO: 38795 - protein, 11 aa, Artificial Sequence
  Description of Artificial Sequence: Synthetic peptide
  XENP020895 vlCDR1
KASQSVSNDVA

SEQ ID NO: 38796 - protein, 7 aa, Artificial Sequence
  Description of Artificial Sequence: Synthetic peptide
  XENP020895 vlCDR2
YASNRYT

SEQ ID NO: 38797 - protein, 8 aa, Artificial Sequence
  Description of Artificial Sequence: Synthetic peptide
  XENP020895 vlCDR3
QQDYSSPT

SEQ ID NO: 38798 - protein, 447 aa, Artificial Sequence; identical to SEQ ID NO: 23236
  Description of Artificial Sequence: Synthetic polypeptide
  XENP021220 9C6_H1.1_L1-1G6_L1.194_H1.279 Fab-Fc Heavy Chain

SEQ ID NO: 38799 - protein, 118 aa, Artificial Sequence; identical to SEQ ID NO: 21205
  Description of Artificial Sequence: Synthetic polypeptide
  VH of XENP021220

SEQ ID NO: 38800 - protein, 5 aa, Artificial Sequence
  Description of Artificial Sequence: Synthetic peptide
  XENP021220 vhCDR1
GYGVN

SEQ ID NO: 38801 - protein, 16 aa, Artificial Sequence
  Description of Artificial Sequence: Synthetic peptide
  XENP021220 vhCDR2
MIWIDGSTDYNSKFQG

SEQ ID NO: 38802 - protein, 10 aa, Artificial Sequence
  Description of Artificial Sequence: Synthetic peptide
  XENP021220 vhCDR3
DRPDGRAMDY

SEQ ID NO: 38803 - protein, 480 aa, Artificial Sequence; identical to SEQ ID NO: 23221
  Description of Artificial Sequence: Synthetic polypeptide
  XENP021220 9C6_H1.1_L1-1G6_L1.194_H1.279 scFv-Fc Heavy Chain

SEQ ID NO: 38804 - protein, 107 aa, Artificial Sequence; identical to SEQ ID NO: 10999
  Description of Artificial Sequence: Synthetic polypeptide
  VH of XENP021220

SEQ ID NO: 38805 - protein, 122 aa, Artificial Sequence; identical to SEQ ID NO: 10908
  Description of Artificial Sequence: Synthetic polypeptide
  VL of XENP021220

SEQ ID NO: 38806 - protein, 231 aa, Artificial Sequence; identical to SEQ ID NO: 21532
  Description of Artificial Sequence: Synthetic polypeptide
  Fc chain of XENP021220

SEQ ID NO: 38807 - protein, 11 aa, Artificial Sequence
  Description of Artificial Sequence: Synthetic peptide
  XENP021220 vhCDR1
RASQSVGNDVA

SEQ ID NO: 38808 - protein, 7 aa, Artificial Sequence
  Description of Artificial Sequence: Synthetic peptide
  XENP021220 vhCDR2
YASHRYT

SEQ ID NO: 38809 - protein, 9 aa, Artificial Sequence
  Description of Artificial Sequence: Synthetic peptide
  XENP021220 vhCDR3
QQDFSSPRT

SEQ ID NO: 38810 - protein, 5 aa, Artificial Sequence
  Description of Artificial Sequence: Synthetic peptide
  XENP021220 vlCDR1
NYWMN

SEQ ID NO: 38811 - protein, 19 aa, Artificial Sequence
  Description of Artificial Sequence: Synthetic peptide
  XENP021220 vlCDR2
EIRLYSNNYATHYAESVKG

SEQ ID NO: 38812 - protein, 11 aa, Artificial Sequence
  Description of Artificial Sequence: Synthetic peptide
  XENP021220 vlCDR3
YYGNYGGYFDV

SEQ ID NO: 38813 - protein, 213 aa, Artificial Sequence; identical to SEQ ID NO: 21050
  Description of Artificial Sequence: Synthetic polypeptide
  XENP021220 9C6_H1.1_L1-1G6_L1.194_H1.279 Light Chain

SEQ ID NO: 38814 - protein, 106 aa, Artificial Sequence; identical to SEQ ID NO: 21051
  Description of Artificial Sequence: Synthetic polypeptide
  VL of XENP021220

SEQ ID NO: 38815 - protein, 11 aa, Artificial Sequence
  Description of Artificial Sequence: Synthetic peptide
  XENP021220 vlCDR1
KASQSVSNDVA

SEQ ID NO: 38816 - protein, 7 aa, Artificial Sequence
  Description of Artificial Sequence: Synthetic peptide
  XENP021220 vlCDR2
YASNRYT

SEQ ID NO: 38817 - protein, 8 aa, Artificial Sequence
  Description of Artificial Sequence: Synthetic peptide
  XENP021220 vlCDR3
QQDYSSPT

SEQ ID NO: 38818 - protein, 447 aa, Artificial Sequence; identical to SEQ ID NO: 23256
  Description of Artificial Sequence: Synthetic polypeptide
  XENP021221 9C6_H1.11_L1-1G6_L1.194_H1.279 Fab-Fc Heavy Chain

SEQ ID NO: 38819 - protein, 118 aa, Artificial Sequence; identical to SEQ ID NO: 21305
  Description of Artificial Sequence: Synthetic polypeptide
  VH of XENP021221

SEQ ID NO: 38820 - protein, 5 aa, Artificial Sequence
  Description of Artificial Sequence: Synthetic peptide
  XENP021221 vhCDR1
GYGVN

SEQ ID NO: 38821 - protein, 16 aa, Artificial Sequence
  Description of Artificial Sequence: Synthetic peptide
  XENP021221 vhCDR2
MIWIDGSTDYNSKFQG

SEQ ID NO: 38822 - protein, 10 aa, Artificial Sequence
  Description of Artificial Sequence: Synthetic peptide
  XENP021221 vhCDR3
DRPDGRAMDY

SEQ ID NO: 38823 - protein, 480 aa, Artificial Sequence; identical to SEQ ID NO: 23221
  Description of Artificial Sequence: Synthetic polypeptide
  XENP021221 9C6_H1.11_L1-1G6_L1.194_H1.279 scFv-Fc Heavy Chain

SEQ ID NO: 38824 - protein, 107 aa, Artificial Sequence; identical to SEQ ID NO: 10999
  Description of Artificial Sequence: Synthetic polypeptide
  VH of XENP021221

SEQ ID NO: 38825 - protein, 122 aa, Artificial Sequence; identical to SEQ ID NO: 10908
  Description of Artificial Sequence: Synthetic polypeptide
  VL of XENP021221

SEQ ID NO: 38826 - protein, 231 aa, Artificial Sequence; identical to SEQ ID NO: 21532
  Description of Artificial Sequence: Synthetic polypeptide
  Fc chain of XENP021221

SEQ ID NO: 38827 - protein, 11 aa, Artificial Sequence
  Description of Artificial Sequence: Synthetic peptide
  XENP021221 vhCDR1
RASQSVGNDVA

SEQ ID NO: 38828 - protein, 7 aa, Artificial Sequence
  Description of Artificial Sequence: Synthetic peptide
  XENP021221 vhCDR2
YASHRYT

SEQ ID NO: 38829 - protein, 9 aa, Artificial Sequence
  Description of Artificial Sequence: Synthetic peptide
  XENP021221 vhCDR3
QQDFSSPRT

SEQ ID NO: 38830 - protein, 5 aa, Artificial Sequence
  Description of Artificial Sequence: Synthetic peptide
  XENP021221 vlCDR1
NYWMN

SEQ ID NO: 38831 - protein, 19 aa, Artificial Sequence
  Description of Artificial Sequence: Synthetic peptide
  XENP021221 vlCDR2
EIRLYSNNYATHYAESVKG

SEQ ID NO: 38832 - protein, 11 aa, Artificial Sequence
  Description of Artificial Sequence: Synthetic peptide
  XENP021221 vlCDR3
YYGNYGGYFDV

SEQ ID NO: 38833 - protein, 213 aa, Artificial Sequence; identical to SEQ ID NO: 21050
  Description of Artificial Sequence: Synthetic polypeptide
  XENP021221 9C6_H1.11_L1-1G6_L1.194_H1.279 Light Chain

SEQ ID NO: 38834 - protein, 106 aa, Artificial Sequence; identical to SEQ ID NO: 21051
  Description of Artificial Sequence: Synthetic polypeptide
  VL of XENP021221

SEQ ID NO: 38835 - protein, 11 aa, Artificial Sequence
  Description of Artificial Sequence: Synthetic peptide
  XENP021221 vlCDR1
KASQSVSNDVA

SEQ ID NO: 38836 - protein, 7 aa, Artificial Sequence
  Description of Artificial Sequence: Synthetic peptide
  XENP021221 vlCDR2
YASNRYT

SEQ ID NO: 38837 - protein, 8 aa, Artificial Sequence
  Description of Artificial Sequence: Synthetic peptide
  XENP021221 vlCDR3
QQDYSSPT

SEQ ID NO: 38838 - protein, 447 aa, Artificial Sequence; identical to SEQ ID NO: 36147
  Description of Artificial Sequence: Synthetic polypeptide
  XENP022858 9C6_H1.1_L1_Fab-1G6_L1.194_H1.279_scFv M428L/N434S Fab-Fc Heavy Chain

SEQ ID NO: 38839 - protein, 118 aa, Artificial Sequence; identical to SEQ ID NO: 21205
  Description of Artificial Sequence: Synthetic polypeptide
  VH of XENP022858

SEQ ID NO: 38840 - protein, 5 aa, Artificial Sequence
  Description of Artificial Sequence: Synthetic peptide
  XENP022858 vhCDR1
GYGVN

SEQ ID NO: 38841 - protein, 16 aa, Artificial Sequence
  Description of Artificial Sequence: Synthetic peptide
  XENP022858 vhCDR2
MIWIDGSTDYNSKFQG

SEQ ID NO: 38842 - protein, 10 aa, Artificial Sequence
  Description of Artificial Sequence: Synthetic peptide
  XENP022858 vhCDR3
DRPDGRAMDY

SEQ ID NO: 38843 - protein, 480 aa, Artificial Sequence; identical to SEQ ID NO: 23581
  Description of Artificial Sequence: Synthetic polypeptide
  XENP022858 9C6_H1.1_L1_Fab-1G6_L1.194_H1.279_scFv M428L/N434S scFv-Fc Heavy Chain

SEQ ID NO: 38844 - protein, 107 aa, Artificial Sequence; identical to SEQ ID NO: 10999
  Description of Artificial Sequence: Synthetic polypeptide
  VH of XENP022858

SEQ ID NO: 38845 - protein, 122 aa, Artificial Sequence; identical to SEQ ID NO: 10908
  Description of Artificial Sequence: Synthetic polypeptide
  VL of XENP022858

SEQ ID NO: 38846 - protein, 231 aa, Artificial Sequence; identical to SEQ ID NO: 21572
  Description of Artificial Sequence: Synthetic polypeptide
  Fc chain of XENP022858

SEQ ID NO: 38847 - protein, 11 aa, Artificial Sequence
  Description of Artificial Sequence: Synthetic peptide
  XENP022858 vhCDR1
RASQSVGNDVA

SEQ ID NO: 38848 - protein, 7 aa, Artificial Sequence
  Description of Artificial Sequence: Synthetic peptide
  XENP022858 vhCDR2
YASHRYT

SEQ ID NO: 38849 - protein, 9 aa, Artificial Sequence
  Description of Artificial Sequence: Synthetic peptide
  XENP022858 vhCDR3
QQDFSSPRT

SEQ ID NO: 38850 - protein, 5 aa, Artificial Sequence
  Description of Artificial Sequence: Synthetic peptide
  XENP022858 vlCDR1
NYWMN

SEQ ID NO: 38851 - protein, 19 aa, Artificial Sequence
  Description of Artificial Sequence: Synthetic peptide
  XENP022858 vlCDR2
EIRLYSNNYATHYAESVKG

SEQ ID NO: 38852 - protein, 11 aa, Artificial Sequence
  Description of Artificial Sequence: Synthetic peptide
  XENP022858 vlCDR3
YYGNYGGYFDV

SEQ ID NO: 38853 - protein, 213 aa, Artificial Sequence; identical to SEQ ID NO: 21050
  Description of Artificial Sequence: Synthetic polypeptide
  XENP022858 9C6_H1.1_L1_Fab-1G6_L1.194_H1.279_scFv M428L/N434S Light Chain

SEQ ID NO: 38854 - protein, 106 aa, Artificial Sequence; identical to SEQ ID NO: 21051
  Description of Artificial Sequence: Synthetic polypeptide
  VL of XENP022858

SEQ ID NO: 38855 - protein, 11 aa, Artificial Sequence
  Description of Artificial Sequence: Synthetic peptide
  XENP022858 vlCDR1
KASQSVSNDVA

SEQ ID NO: 38856 - protein, 7 aa, Artificial Sequence
  Description of Artificial Sequence: Synthetic peptide
  XENP022858 vlCDR2
YASNRYT

SEQ ID NO: 38857 - protein, 8 aa, Artificial Sequence
  Description of Artificial Sequence: Synthetic peptide
  XENP022858 vlCDR3
QQDYSSPT

SEQ ID NO: 38858 - protein, 447 aa, Artificial Sequence; identical to SEQ ID NO: 17235
  Description of Artificial Sequence: Synthetic polypeptide
  XENP020153 2A11_H1L2-[CTLA-4]_H3.4_L0.12 Fab-Fc Heavy Chain

SEQ ID NO: 38859 - protein, 118 aa, Artificial Sequence; identical to SEQ ID NO: 17236
  Description of Artificial Sequence: Synthetic polypeptide
  VH of XENP020153

SEQ ID NO: 38860 - protein, 5 aa, Artificial Sequence
  Description of Artificial Sequence: Synthetic peptide
  XENP020153 vhCDR1
DYYMH

SEQ ID NO: 38861 - protein, 17 aa, Artificial Sequence
  Description of Artificial Sequence: Synthetic peptide
  XENP020153 vhCDR2
WIDPENGDTEYAPKFQG

SEQ ID NO: 38862 - protein, 9 aa, Artificial Sequence
  Description of Artificial Sequence: Synthetic peptide
  XENP020153 vhCDR3
RGVRQALDY

SEQ ID NO: 38863 - protein, 477 aa, Artificial Sequence; identical to SEQ ID NO: 21549
  Description of Artificial Sequence: Synthetic polypeptide
  XENP020153 2A11_H1L2-[CTLA-4]_H3.4_L0.12 scFv-Fc Heavy Chain

SEQ ID NO: 38864 - protein, 118 aa, Artificial Sequence; identical to SEQ ID NO: 2461
  Description of Artificial Sequence: Synthetic polypeptide
  VH of XENP020153

SEQ ID NO: 38865 - protein, 108 aa, Artificial Sequence; identical to SEQ ID NO: 1517
  Description of Artificial Sequence: Synthetic polypeptide
  VL of XENP020153

SEQ ID NO: 38866 - protein, 231 aa, Artificial Sequence; identical to SEQ ID NO: 21532
  Description of Artificial Sequence: Synthetic polypeptide
  Fc chain of XENP020153

SEQ ID NO: 38867 - protein, 5 aa, Artificial Sequence
  Description of Artificial Sequence: Synthetic peptide
  XENP020153 vhCDR1
SYTMH

SEQ ID NO: 38868 - protein, 17 aa, Artificial Sequence
  Description of Artificial Sequence: Synthetic peptide
  XENP020153 vhCDR2
FISYDGNHKYYADSVKG

SEQ ID NO: 38869 - protein, 9 aa, Artificial Sequence
  Description of Artificial Sequence: Synthetic peptide
  XENP020153 vhCDR3
TGHLGPFDL

SEQ ID NO: 38870 - protein, 12 aa, Artificial Sequence
  Description of Artificial Sequence: Synthetic peptide
  XENP020153 vlCDR1
RASQSVGSSYLA

SEQ ID NO: 38871 - protein, 7 aa, Artificial Sequence
  Description of Artificial Sequence: Synthetic peptide
  XENP020153 vlCDR2
GAFSRAT

SEQ ID NO: 38872 - protein, 9 aa, Artificial Sequence
  Description of Artificial Sequence: Synthetic peptide
  XENP020153 vlCDR3
QQYGSSPWT

SEQ ID NO: 38873 - protein, 214 aa, Artificial Sequence; identical to SEQ ID NO: 17250
  Description of Artificial Sequence: Synthetic polypeptide
  XENP020153 2A11_H1L2-[CTLA-4]_H3.4_L0.12 Light Chain

SEQ ID NO: 38874 - protein, 107 aa, Artificial Sequence; identical to SEQ ID NO: 17251
  Description of Artificial Sequence: Synthetic polypeptide
  VL of XENP020153

SEQ ID NO: 38875 - protein, 11 aa, Artificial Sequence
  Description of Artificial Sequence: Synthetic peptide
  XENP020153 vlCDR1
QASQDIGNYLN

SEQ ID NO: 38876 - protein, 7 aa, Artificial Sequence
  Description of Artificial Sequence: Synthetic peptide
  XENP020153 vlCDR2
YTSRLHS

SEQ ID NO: 38877 - protein, 9 aa, Artificial Sequence
  Description of Artificial Sequence: Synthetic peptide
  XENP020153 vlCDR3
QQGNTLPYT

SEQ ID NO: 38878 - protein, 450 aa, Artificial Sequence; identical to SEQ ID NO: 22304
  Description of Artificial Sequence: Synthetic polypeptide
  XENP020833 7G8_H3L1_Fab-[CTLA-4]_H3.23_L0.129 Fab-Fc Heavy Chain

SEQ ID NO: 38879 - protein, 121 aa, Artificial Sequence; identical to SEQ ID NO: 17806
  Description of Artificial Sequence: Synthetic polypeptide
  VH of XENP020833

SEQ ID NO: 38880 - protein, 5 aa, Artificial Sequence
  Description of Artificial Sequence: Synthetic peptide
  XENP020833 vhCDR1
DAWMD

SEQ ID NO: 38881 - protein, 19 aa, Artificial Sequence
  Description of Artificial Sequence: Synthetic peptide
  XENP020833 vhCDR2
EIRTKANNHATYYAESVKG

SEQ ID NO: 38882 - protein, 10 aa, Artificial Sequence
  Description of Artificial Sequence: Synthetic peptide
  XENP020833 vhCDR3
LANWDWYFDV

SEQ ID NO: 38883 - protein, 477 aa, Artificial Sequence; identical to SEQ ID NO: 21669
  Description of Artificial Sequence: Synthetic polypeptide
  XENP020833 7G8_H3L1_Fab-[CTLA-4]_H3.23_L0.129 scFv-Fc Heavy Chain

SEQ ID NO: 38884 - protein, 118 aa, Artificial Sequence; identical to SEQ ID NO: 2632
  Description of Artificial Sequence: Synthetic polypeptide
  VH of XENP020833

SEQ ID NO: 38885 - protein, 108 aa, Artificial Sequence; identical to SEQ ID NO: 2768
  Description of Artificial Sequence: Synthetic polypeptide
  VL of XENP020833

SEQ ID NO: 38886 - protein, 231 aa, Artificial Sequence; identical to SEQ ID NO: 21532
  Description of Artificial Sequence: Synthetic polypeptide
  Fc chain of XENP020833

SEQ ID NO: 38887 - protein, 5 aa, Artificial Sequence
  Description of Artificial Sequence: Synthetic peptide
  XENP020833 vhCDR1
SYTMH

SEQ ID NO: 38888 - protein, 17 aa, Artificial Sequence
  Description of Artificial Sequence: Synthetic peptide
  XENP020833 vhCDR2
FISYDGNYKYYADSVKG

SEQ ID NO: 38889 - protein, 9 aa, Artificial Sequence
  Description of Artificial Sequence: Synthetic peptide
  XENP020833 vhCDR3
GGHLGPFDL

SEQ ID NO: 38890 - protein, 12 aa, Artificial Sequence
  Description of Artificial Sequence: Synthetic peptide
  XENP020833 vlCDR1
RASQSVGSSYLA

SEQ ID NO: 38891 - protein, 7 aa, Artificial Sequence
  Description of Artificial Sequence: Synthetic peptide
  XENP020833 vlCDR2
GASSRAT

SEQ ID NO: 38892 - protein, 9 aa, Artificial Sequence
  Description of Artificial Sequence: Synthetic peptide
  XENP020833 vlCDR3
QQYGSSPWT

SEQ ID NO: 38893 - protein, 218 aa, Artificial Sequence; identical to SEQ ID NO: 17600
  Description of Artificial Sequence: Synthetic polypeptide
  XENP020833 7G8_H3L1_Fab-[CTLA-4]_H3.23_L0.129 Light Chain

SEQ ID NO: 38894 - protein, 111 aa, Artificial Sequence; identical to SEQ ID NO: 17601
  Description of Artificial Sequence: Synthetic polypeptide
  VL of XENP020833

SEQ ID NO: 38895 - protein, 15 aa, Artificial Sequence
  Description of Artificial Sequence: Synthetic peptide
  XENP020833 vlCDR1
RASQSVDYDGDSYMN

SEQ ID NO: 38896 - protein, 7 aa, Artificial Sequence
  Description of Artificial Sequence: Synthetic peptide
  XENP020833 vlCDR2
AASNLES

SEQ ID NO: 38897 - protein, 9 aa, Artificial Sequence
  Description of Artificial Sequence: Synthetic peptide
  XENP020833 vlCDR3
QQSNEDPFT

SEQ ID NO: 38898 - protein, 447 aa, Artificial Sequence; identical to SEQ ID NO: 17235
  Description of Artificial Sequence: Synthetic polypeptide
  XENP021859 2A11_H1_L2.47_Fab-[CTLA-4]_H3.23_L0.129 Fab-Fc Heavy Chain

SEQ ID NO: 38899 - protein, 118 aa, Artificial Sequence; identical to SEQ ID NO: 17236
  Description of Artificial Sequence: Synthetic polypeptide
  VH of XENP021859

SEQ ID NO: 38900 - protein, 5 aa, Artificial Sequence
  Description of Artificial Sequence: Synthetic peptide
  XENP021859 vhCDR1
DYYMH

SEQ ID NO: 38901 - protein, 17 aa, Artificial Sequence
  Description of Artificial Sequence: Synthetic peptide
  XENP021859 vhCDR2
WIDPENGDTEYAPKFQG

SEQ ID NO: 38902 - protein, 9 aa, Artificial Sequence
  Description of Artificial Sequence: Synthetic peptide
  XENP021859 vhCDR3
RGVRQALDY

SEQ ID NO: 38903 - protein, 477 aa, Artificial Sequence; identical to SEQ ID NO: 21669
  Description of Artificial Sequence: Synthetic polypeptide
  XENP021859 2A11_H1_L2.47_Fab-[CTLA-4]_H3.23_L0.129 scFv-Fc Heavy Chain

SEQ ID NO: 38904 - protein, 118 aa, Artificial Sequence; identical to SEQ ID NO: 2632
  Description of Artificial Sequence: Synthetic polypeptide
  VH of XENP021859

SEQ ID NO: 38905 - protein, 108 aa, Artificial Sequence; identical to SEQ ID NO: 2768
  Description of Artificial Sequence: Synthetic polypeptide
  VL of XENP021859

SEQ ID NO: 38906 - protein, 231 aa, Artificial Sequence; identical to SEQ ID NO: 21532
  Description of Artificial Sequence: Synthetic polypeptide
  Fc chain of XENP021859

SEQ ID NO: 38907 - protein, 5 aa, Artificial Sequence
  Description of Artificial Sequence: Synthetic peptide
  XENP021859 vhCDR1
SYTMH

SEQ ID NO: 38908 - protein, 17 aa, Artificial Sequence
  Description of Artificial Sequence: Synthetic peptide
  XENP021859 vhCDR2
FISYDGNYKYYADSVKG

SEQ ID NO: 38909 - protein, 9 aa, Artificial Sequence
  Description of Artificial Sequence: Synthetic peptide
  XENP021859 vhCDR3
GGHLGPFDL

SEQ ID NO: 38910 - protein, 12 aa, Artificial Sequence
  Description of Artificial Sequence: Synthetic peptide
  XENP021859 vlCDR1
RASQSVGSSYLA

SEQ ID NO: 38911 - protein, 7 aa, Artificial Sequence
  Description of Artificial Sequence: Synthetic peptide
  XENP021859 vlCDR2
GASSRAT

SEQ ID NO: 38912 - protein, 9 aa, Artificial Sequence
  Description of Artificial Sequence: Synthetic peptide
  XENP021859 vlCDR3
QQYGSSPWT

SEQ ID NO: 38913 - protein, 214 aa, Artificial Sequence; identical to SEQ ID NO: 22039
  Description of Artificial Sequence: Synthetic polypeptide
  XENP021859 2A11_H1_L2.47_Fab-[CTLA-4]_H3.23_L0.129 Light Chain

SEQ ID NO: 38914 - protein, 107 aa, Artificial Sequence; identical to SEQ ID NO: 22040
  Description of Artificial Sequence: Synthetic polypeptide
  VL of XENP021859

SEQ ID NO: 38915 - protein, 11 aa, Artificial Sequence
  Description of Artificial Sequence: Synthetic peptide
  XENP021859 vlCDR1
QASQDIGNYLN

SEQ ID NO: 38916 - protein, 7 aa, Artificial Sequence
  Description of Artificial Sequence: Synthetic peptide
  XENP021859 vlCDR2
YTSHLHS

SEQ ID NO: 38917 - protein, 9 aa, Artificial Sequence
  Description of Artificial Sequence: Synthetic peptide
  XENP021859 vlCDR3
QQGNTLPYT

SEQ ID NO: 38918 - protein, 447 aa, Artificial Sequence; identical to SEQ ID NO: 17235
  Description of Artificial Sequence: Synthetic polypeptide
  XENP021860 2A11_H1_L2.50_Fab-[CTLA-4]_H3.23_L0.129 Fab-Fc Heavy Chain

SEQ ID NO: 38919 - protein, 118 aa, Artificial Sequence; identical to SEQ ID NO: 17236
  Description of Artificial Sequence: Synthetic polypeptide
  VH of XENP021860

SEQ ID NO: 38920 - protein, 5 aa, Artificial Sequence
  Description of Artificial Sequence: Synthetic peptide
  XENP021860 vhCDR1
DYYMH

SEQ ID NO: 38921 - protein, 17 aa, Artificial Sequence
  Description of Artificial Sequence: Synthetic peptide
  XENP021860 vhCDR2
WIDPENGDTEYAPKFQG

SEQ ID NO: 38922 - protein, 9 aa, Artificial Sequence
  Description of Artificial Sequence: Synthetic peptide
  XENP021860 vhCDR3
RGVRQALDY

SEQ ID NO: 38923 - protein, 477 aa, Artificial Sequence; identical to SEQ ID NO: 21669
  Description of Artificial Sequence: Synthetic polypeptide
  XENP021860 2A11_H1_L2.50_Fab-[CTLA-4]_H3.23_L0.129 scFv-Fc Heavy Chain

SEQ ID NO: 38924 - protein, 118 aa, Artificial Sequence; identical to SEQ ID NO: 2632
  Description of Artificial Sequence: Synthetic polypeptide
  VH of XENP021860

SEQ ID NO: 38925 - protein, 108 aa, Artificial Sequence; identical to SEQ ID NO: 2768
  Description of Artificial Sequence: Synthetic polypeptide
  VL of XENP021860

SEQ ID NO: 38926 - protein, 231 aa, Artificial Sequence; identical to SEQ ID NO: 21532
  Description of Artificial Sequence: Synthetic polypeptide
  Fc chain of XENP021860

SEQ ID NO: 38927 - protein, 5 aa, Artificial Sequence
  Description of Artificial Sequence: Synthetic peptide
  XENP021860 vhCDR1
SYTMH

SEQ ID NO: 38928 - protein, 17 aa, Artificial Sequence
  Description of Artificial Sequence: Synthetic peptide
  XENP021860 vhCDR2
FISYDGNYKYYADSVKG

SEQ ID NO: 38929 - protein, 9 aa, Artificial Sequence
  Description of Artificial Sequence: Synthetic peptide
  XENP021860 vhCDR3
GGHLGPFDL

SEQ ID NO: 38930 - protein, 12 aa, Artificial Sequence
  Description of Artificial Sequence: Synthetic peptide
  XENP021860 vlCDR1
RASQSVGSSYLA

SEQ ID NO: 38931 - protein, 7 aa, Artificial Sequence
  Description of Artificial Sequence: Synthetic peptide
  XENP021860 vlCDR2
GASSRAT

SEQ ID NO: 38932 - protein, 9 aa, Artificial Sequence
  Description of Artificial Sequence: Synthetic peptide
  XENP021860 vlCDR3
QQYGSSPWT

SEQ ID NO: 38933 - protein, 214 aa, Artificial Sequence; identical to SEQ ID NO: 22059
  Description of Artificial Sequence: Synthetic polypeptide
  XENP021860 2A11_H1_L2.50_Fab-[CTLA-4]_H3.23_L0.129 Light Chain

SEQ ID NO: 38934 - protein, 107 aa, Artificial Sequence; identical to SEQ ID NO: 22060
  Description of Artificial Sequence: Synthetic polypeptide
  VL of XENP021860

SEQ ID NO: 38935 - protein, 11 aa, Artificial Sequence
  Description of Artificial Sequence: Synthetic peptide
  XENP021860 vlCDR1
QASQDIGNYLN

SEQ ID NO: 38936 - protein, 7 aa, Artificial Sequence
  Description of Artificial Sequence: Synthetic peptide
  XENP021860 vlCDR2
YTSYLHS

SEQ ID NO: 38937 - protein, 9 aa, Artificial Sequence
  Description of Artificial Sequence: Synthetic peptide
  XENP021860 vlCDR3
QQGNTLPYT

SEQ ID NO: 38938 - protein, 450 aa, Artificial Sequence; identical to SEQ ID NO: 22324
  Description of Artificial Sequence: Synthetic polypeptide
  XENP021895 7G8_H3.18_L1-[CTLA-4]_H3.23_L0.129 Fab-Fc Heavy Chain

SEQ ID NO: 38939 - protein, 121 aa, Artificial Sequence; identical to SEQ ID NO: 22325
  Description of Artificial Sequence: Synthetic polypeptide
  VH of XENP021895

SEQ ID NO: 38940 - protein, 5 aa, Artificial Sequence
  Description of Artificial Sequence: Synthetic peptide
  XENP021895 vhCDR1
DAWMD

SEQ ID NO: 38941 - protein, 19 aa, Artificial Sequence
  Description of Artificial Sequence: Synthetic peptide
  XENP021895 vhCDR2
EISTKANNHATYYAESVKG

SEQ ID NO: 38942 - protein, 10 aa, Artificial Sequence
  Description of Artificial Sequence: Synthetic peptide
  XENP021895 vhCDR3
LATWDWYFDV

SEQ ID NO: 38943 - protein, 477 aa, Artificial Sequence; identical to SEQ ID NO: 21669
  Description of Artificial Sequence: Synthetic polypeptide
  XENP021895 7G8_H3.18_L1-[CTLA-4]_H3.23_L0.129 scFv-Fc Heavy Chain

SEQ ID NO: 38944 - protein, 118 aa, Artificial Sequence; identical to SEQ ID NO: 2632
  Description of Artificial Sequence: Synthetic polypeptide
  VH of XENP021895

SEQ ID NO: 38945 - protein, 108 aa, Artificial Sequence; identical to SEQ ID NO: 2768
  Description of Artificial Sequence: Synthetic polypeptide
  VL of XENP021895

SEQ ID NO: 38946 - protein, 231 aa, Artificial Sequence; identical to SEQ ID NO: 21532
  Description of Artificial Sequence: Synthetic polypeptide
  Fc chain of XENP021895

SEQ ID NO: 38947 - protein, 5 aa, Artificial Sequence
  Description of Artificial Sequence: Synthetic peptide
  XENP021895 vhCDR1
SYTMH

SEQ ID NO: 38948 - protein, 17 aa, Artificial Sequence
  Description of Artificial Sequence: Synthetic peptide
  XENP021895 vhCDR2
FISYDGNYKYYADSVKG

SEQ ID NO: 38949 - protein, 9 aa, Artificial Sequence
  Description of Artificial Sequence: Synthetic peptide
  XENP021895 vhCDR3
GGHLGPFDL

SEQ ID NO: 38950 - protein, 12 aa, Artificial Sequence
  Description of Artificial Sequence: Synthetic peptide
  XENP021895 vlCDR1
RASQSVGSSYLA

SEQ ID NO: 38951 - protein, 7 aa, Artificial Sequence
  Description of Artificial Sequence: Synthetic peptide
  XENP021895 vlCDR2
GASSRAT

SEQ ID NO: 38952 - protein, 9 aa, Artificial Sequence
  Description of Artificial Sequence: Synthetic peptide
  XENP021895 vlCDR3
QQYGSSPWT

SEQ ID NO: 38953 - protein, 218 aa, Artificial Sequence; identical to SEQ ID NO: 17600
  Description of Artificial Sequence: Synthetic polypeptide
  XENP021895 7G8_H3.18_L1-[CTLA-4]_H3.23_L0.129 Light Chain

SEQ ID NO: 38954 - protein, 111 aa, Artificial Sequence; identical to SEQ ID NO: 17601
  Description of Artificial Sequence: Synthetic polypeptide
  VL of XENP021895

SEQ ID NO: 38955 - protein, 15 aa, Artificial Sequence
  Description of Artificial Sequence: Synthetic peptide
  XENP021895 vlCDR1
RASQSVDYDGDSYMN

SEQ ID NO: 38956 - protein, 7 aa, Artificial Sequence
  Description of Artificial Sequence: Synthetic peptide
  XENP021895 vlCDR2
AASNLES

SEQ ID NO: 38957 - protein, 9 aa, Artificial Sequence
  Description of Artificial Sequence: Synthetic peptide
  XENP021895 vlCDR3
QQSNEDPFT

SEQ ID NO: 38958 - protein, 450 aa, Artificial Sequence; identical to SEQ ID NO: 22324
  Description of Artificial Sequence: Synthetic polypeptide
  XENP021896 7G8_H3.18_L1.11-[CTLA-4]_H3.23_L0.129 Fab-Fc Heavy Chain

SEQ ID NO: 38959 - protein, 121 aa, Artificial Sequence; identical to SEQ ID NO: 22325
  Description of Artificial Sequence: Synthetic polypeptide
  VH of XENP021896

SEQ ID NO: 38960 - protein, 5 aa, Artificial Sequence
  Description of Artificial Sequence: Synthetic peptide
  XENP021896 vhCDR1
DAWMD

SEQ ID NO: 38961 - protein, 19 aa, Artificial Sequence
  Description of Artificial Sequence: Synthetic peptide
  XENP021896 vhCDR2
EISTKANNHATYYAESVKG

SEQ ID NO: 38962 - protein, 10 aa, Artificial Sequence
  Description of Artificial Sequence: Synthetic peptide
  XENP021896 vhCDR3
LATWDWYFDV

SEQ ID NO: 38963 - protein, 477 aa, Artificial Sequence; identical to SEQ ID NO: 21669
  Description of Artificial Sequence: Synthetic polypeptide
  XENP021896 7G8_H3.18_L1.11-[CTLA-4]_H3.23_L0.129 scFv-Fc Heavy Chain

SEQ ID NO: 38964 - protein, 118 aa, Artificial Sequence; identical to SEQ ID NO: 2632
  Description of Artificial Sequence: Synthetic polypeptide
  VH of XENP021896

SEQ ID NO: 38965 - protein, 108 aa, Artificial Sequence; identical to SEQ ID NO: 2768
  Description of Artificial Sequence: Synthetic polypeptide
  VL of XENP021896

SEQ ID NO: 38966 - protein, 231 aa, Artificial Sequence; identical to SEQ ID NO: 21532
  Description of Artificial Sequence: Synthetic polypeptide
  Fc chain of XENP021896

SEQ ID NO: 38967 - protein, 5 aa, Artificial Sequence
  Description of Artificial Sequence: Synthetic peptide
  XENP021896 vhCDR1
SYTMH

SEQ ID NO: 38968 - protein, 17 aa, Artificial Sequence
  Description of Artificial Sequence: Synthetic peptide
  XENP021896 vhCDR2
FISYDGNYKYYADSVKG

SEQ ID NO: 38969 - protein, 9 aa, Artificial Sequence
  Description of Artificial Sequence: Synthetic peptide
  XENP021896 vhCDR3
GGHLGPFDL

SEQ ID NO: 38970 - protein, 12 aa, Artificial Sequence
  Description of Artificial Sequence: Synthetic peptide
  XENP021896 vlCDR1
RASQSVGSSYLA

SEQ ID NO: 38971 - protein, 7 aa, Artificial Sequence
  Description of Artificial Sequence: Synthetic peptide
  XENP021896 vlCDR2
GASSRAT

SEQ ID NO: 38972 - protein, 9 aa, Artificial Sequence
  Description of Artificial Sequence: Synthetic peptide
  XENP021896 vlCDR3
QQYGSSPWT

SEQ ID NO: 38973 - protein, 218 aa, Artificial Sequence; identical to SEQ ID NO: 22359
  Description of Artificial Sequence: Synthetic polypeptide
  XENP021896 7G8_H3.18_L1.11-[CTLA-4]_H3.23_L0.129 Light Chain

SEQ ID NO: 38974 - protein, 111 aa, Artificial Sequence; identical to SEQ ID NO: 22360
  Description of Artificial Sequence: Synthetic polypeptide
  VL of XENP021896

SEQ ID NO: 38975 - protein, 15 aa, Artificial Sequence
  Description of Artificial Sequence: Synthetic peptide
  XENP021896 vlCDR1
RASQSVDYDGDSYMN

SEQ ID NO: 38976 - protein, 7 aa, Artificial Sequence
  Description of Artificial Sequence: Synthetic peptide
  XENP021896 vlCDR2
AASELES

SEQ ID NO: 38977 - protein, 9 aa, Artificial Sequence
  Description of Artificial Sequence: Synthetic peptide
  XENP021896 vlCDR3
QQSNEDPFT

SEQ ID NO: 38978 - protein, 450 aa, Artificial Sequence; identical to SEQ ID NO: 22384
  Description of Artificial Sequence: Synthetic polypeptide
  XENP021902 7G8_H3.23_L1.11-[CTLA-4]_H3.23_L0.129 Fab-Fc Heavy Chain

SEQ ID NO: 38979 - protein, 121 aa, Artificial Sequence; identical to SEQ ID NO: 22385
  Description of Artificial Sequence: Synthetic polypeptide
  VH of XENP021902

SEQ ID NO: 38980 - protein, 5 aa, Artificial Sequence
  Description of Artificial Sequence: Synthetic peptide
  XENP021902 vhCDR1
DAWMD

SEQ ID NO: 38981 - protein, 19 aa, Artificial Sequence
  Description of Artificial Sequence: Synthetic peptide
  XENP021902 vhCDR2
EISTKANNHATYYAESVKG

SEQ ID NO: 38982 - protein, 10 aa, Artificial Sequence
  Description of Artificial Sequence: Synthetic peptide
  XENP021902 vhCDR3
LATWDWYFDV

SEQ ID NO: 38983 - protein, 477 aa, Artificial Sequence; identical to SEQ ID NO: 21669
  Description of Artificial Sequence: Synthetic polypeptide
  XENP021902 7G8_H3.23_L1.11-[CTLA-4]_H3.23_L0.129 scFv-Fc Heavy Chain

SEQ ID NO: 38984 - protein, 118 aa, Artificial Sequence; identical to SEQ ID NO: 2632
  Description of Artificial Sequence: Synthetic polypeptide
  VH of XENP021902

SEQ ID NO: 38985 - protein, 108 aa, Artificial Sequence; identical to SEQ ID NO: 2768
  Description of Artificial Sequence: Synthetic polypeptide
  VL of XENP021902

SEQ ID NO: 38986 - protein, 231 aa, Artificial Sequence; identical to SEQ ID NO: 21532
  Description of Artificial Sequence: Synthetic polypeptide
  Fc chain of XENP021902

SEQ ID NO: 38987 - protein, 5 aa, Artificial Sequence
  Description of Artificial Sequence: Synthetic peptide
  XENP021902 vhCDR1
SYTMH

SEQ ID NO: 38988 - protein, 17 aa, Artificial Sequence
  Description of Artificial Sequence: Synthetic peptide
  XENP021902 vhCDR2
FISYDGNYKYYADSVKG

SEQ ID NO: 38989 - protein, 9 aa, Artificial Sequence
  Description of Artificial Sequence: Synthetic peptide
  XENP021902 vhCDR3
GGHLGPFDL

SEQ ID NO: 38990 - protein, 12 aa, Artificial Sequence
  Description of Artificial Sequence: Synthetic peptide
  XENP021902 vlCDR1
RASQSVGSSYLA

SEQ ID NO: 38991 - protein, 7 aa, Artificial Sequence
  Description of Artificial Sequence: Synthetic peptide
  XENP021902 vlCDR2
GASSRAT

SEQ ID NO: 38992 - protein, 9 aa, Artificial Sequence
  Description of Artificial Sequence: Synthetic peptide
  XENP021902 vlCDR3
QQYGSSPWT

SEQ ID NO: 38993 - protein, 218 aa, Artificial Sequence; identical to SEQ ID NO: 22359
  Description of Artificial Sequence: Synthetic polypeptide
  XENP021902 7G8_H3.23_L1.11-[CTLA-4]_H3.23_L0.129 Light Chain

SEQ ID NO: 38994 - protein, 111 aa, Artificial Sequence; identical to SEQ ID NO: 22360
  Description of Artificial Sequence: Synthetic polypeptide
  VL of XENP021902

SEQ ID NO: 38995 - protein, 15 aa, Artificial Sequence
  Description of Artificial Sequence: Synthetic peptide
  XENP021902 vlCDR1
RASQSVDYDGDSYMN

SEQ ID NO: 38996 - protein, 7 aa, Artificial Sequence
  Description of Artificial Sequence: Synthetic peptide
  XENP021902 vlCDR2
AASELES

SEQ ID NO: 38997 - protein, 9 aa, Artificial Sequence
  Description of Artificial Sequence: Synthetic peptide
  XENP021902 vlCDR3
QQSNEDPFT

SEQ ID NO: 38998 - protein, 450 aa, Artificial Sequence; identical to SEQ ID NO: 22424
  Description of Artificial Sequence: Synthetic polypeptide
  XENP021904 7G8_H3.28_L1-[CTLA-4]_H3.23_L0.129 Fab-Fc Heavy Chain

SEQ ID NO: 38999 - protein, 121 aa, Artificial Sequence; identical to SEQ ID NO: 22425
  Description of Artificial Sequence: Synthetic polypeptide
  VH of XENP021904

SEQ ID NO: 39000 - protein, 5 aa, Artificial Sequence
  Description of Artificial Sequence: Synthetic peptide
  XENP021904 vhCDR1
DAWMD

SEQ ID NO: 39001 - protein, 19 aa, Artificial Sequence
  Description of Artificial Sequence: Synthetic peptide
  XENP021904 vhCDR2
EISTKAYNHATYYAESVKG

SEQ ID NO: 39002 - protein, 10 aa, Artificial Sequence
  Description of Artificial Sequence: Synthetic peptide
  XENP021904 vhCDR3
LATWDWYFDV

SEQ ID NO: 39003 - protein, 477 aa, Artificial Sequence; identical to SEQ ID NO: 21669
  Description of Artificial Sequence: Synthetic polypeptide
  XENP021904 7G8_H3.28_L1-[CTLA-4]_H3.23_L0.129 scFv-Fc Heavy Chain

SEQ ID NO: 39004 - protein, 118 aa, Artificial Sequence; identical to SEQ ID NO: 2632
  Description of Artificial Sequence: Synthetic polypeptide
  VH of XENP021904

SEQ ID NO: 39005 - protein, 108 aa, Artificial Sequence; identical to SEQ ID NO: 2768
  Description of Artificial Sequence: Synthetic polypeptide
  VL of XENP021904

SEQ ID NO: 39006 - protein, 231 aa, Artificial Sequence; identical to SEQ ID NO: 21532
  Description of Artificial Sequence: Synthetic polypeptide
  Fc chain of XENP021904

SEQ ID NO: 39007 - protein, 5 aa, Artificial Sequence
  Description of Artificial Sequence: Synthetic peptide
  XENP021904 vhCDR1
SYTMH

SEQ ID NO: 39008 - protein, 17 aa, Artificial Sequence
  Description of Artificial Sequence: Synthetic peptide
  XENP021904 vhCDR2
FISYDGNYKYYADSVKG

SEQ ID NO: 39009 - protein, 9 aa, Artificial Sequence
  Description of Artificial Sequence: Synthetic peptide
  XENP021904 vhCDR3
GGHLGPFDL

SEQ ID NO: 39010 - protein, 12 aa, Artificial Sequence
  Description of Artificial Sequence: Synthetic peptide
  XENP021904 vlCDR1
RASQSVGSSYLA

SEQ ID NO: 39011 - protein, 7 aa, Artificial Sequence
  Description of Artificial Sequence: Synthetic peptide
  XENP021904 vlCDR2
GASSRAT

SEQ ID NO: 39012 - protein, 9 aa, Artificial Sequence
  Description of Artificial Sequence: Synthetic peptide
  XENP021904 vlCDR3
QQYGSSPWT

SEQ ID NO: 39013 - protein, 218 aa, Artificial Sequence; identical to SEQ ID NO: 17600
  Description of Artificial Sequence: Synthetic polypeptide
  XENP021904 7G8_H3.28_L1-[CTLA-4]_H3.23_L0.129 Light Chain

SEQ ID NO: 39014 - protein, 111 aa, Artificial Sequence; identical to SEQ ID NO: 17601
  Description of Artificial Sequence: Synthetic polypeptide
  VL of XENP021904

SEQ ID NO: 39015 - protein, 15 aa, Artificial Sequence
  Description of Artificial Sequence: Synthetic peptide
  XENP021904 vlCDR1
RASQSVDYDGDSYMN

SEQ ID NO: 39016 - protein, 7 aa, Artificial Sequence
  Description of Artificial Sequence: Synthetic peptide
  XENP021904 vlCDR2
AASNLES

SEQ ID NO: 39017 - protein, 9 aa, Artificial Sequence
  Description of Artificial Sequence: Synthetic peptide
  XENP021904 vlCDR3
QQSNEDPFT

SEQ ID NO: 39018 - protein, 450 aa, Artificial Sequence; identical to SEQ ID NO: 22424
  Description of Artificial Sequence: Synthetic polypeptide
  XENP021905 7G8_H3.28_L1.11-[CTLA-4]_H3.23_L0.129 Fab-Fc Heavy Chain

SEQ ID NO: 39019 - protein, 121 aa, Artificial Sequence; identical to SEQ ID NO: 22425
  Description of Artificial Sequence: Synthetic polypeptide
  VH of XENP021905

SEQ ID NO: 39020 - protein, 5 aa, Artificial Sequence
  Description of Artificial Sequence: Synthetic peptide
  XENP021905 vhCDR1
DAWMD

SEQ ID NO: 39021 - protein, 19 aa, Artificial Sequence
  Description of Artificial Sequence: Synthetic peptide
  XENP021905 vhCDR2
EISTKAYNHATYYAESVKG

SEQ ID NO: 39022 - protein, 10 aa, Artificial Sequence
  Description of Artificial Sequence: Synthetic peptide
  XENP021905 vhCDR3
LATWDWYFDV

SEQ ID NO: 39023 - protein, 477 aa, Artificial Sequence; identical to SEQ ID NO: 21669
  Description of Artificial Sequence: Synthetic polypeptide
  XENP021905 7G8_H3.28_L1.11-[CTLA-4]_H3.23_L0.129 scFv-Fc Heavy Chain

SEQ ID NO: 39024 - protein, 118 aa, Artificial Sequence; identical to SEQ ID NO: 2632
  Description of Artificial Sequence: Synthetic polypeptide
  VH of XENP021905

SEQ ID NO: 39025 - protein, 108 aa, Artificial Sequence; identical to SEQ ID NO: 2768
  Description of Artificial Sequence: Synthetic polypeptide
  VL of XENP021905

SEQ ID NO: 39026 - protein, 231 aa, Artificial Sequence; identical to SEQ ID NO: 21532
  Description of Artificial Sequence: Synthetic polypeptide
  Fc chain of XENP021905

SEQ ID NO: 39027 - protein, 5 aa, Artificial Sequence
  Description of Artificial Sequence: Synthetic peptide
  XENP021905 vhCDR1
SYTMH

SEQ ID NO: 39028 - protein, 17 aa, Artificial Sequence
  Description of Artificial Sequence: Synthetic peptide
  XENP021905 vhCDR2
FISYDGNYKYYADSVKG

SEQ ID NO: 39029 - protein, 9 aa, Artificial Sequence
  Description of Artificial Sequence: Synthetic peptide
  XENP021905 vhCDR3
GGHLGPFDL

SEQ ID NO: 39030 - protein, 12 aa, Artificial Sequence
  Description of Artificial Sequence: Synthetic peptide
  XENP021905 vlCDR1
RASQSVGSSYLA

SEQ ID NO: 39031 - protein, 7 aa, Artificial Sequence
  Description of Artificial Sequence: Synthetic peptide
  XENP021905 vlCDR2
GASSRAT

SEQ ID NO: 39032 - protein, 9 aa, Artificial Sequence
  Description of Artificial Sequence: Synthetic peptide
  XENP021905 vlCDR3
QQYGSSPWT

SEQ ID NO: 39033 - protein, 218 aa, Artificial Sequence; identical to SEQ ID NO: 22359
  Description of Artificial Sequence: Synthetic polypeptide
  XENP021905 7G8_H3.28_L1.11-[CTLA-4]_H3.23_L0.129 Light Chain

SEQ ID NO: 39034 - protein, 111 aa, Artificial Sequence; identical to SEQ ID NO: 22360
  Description of Artificial Sequence: Synthetic polypeptide
  VL of XENP021905

SEQ ID NO: 39035 - protein, 15 aa, Artificial Sequence
  Description of Artificial Sequence: Synthetic peptide
  XENP021905 vlCDR1
RASQSVDYDGDSYMN

SEQ ID NO: 39036 - protein, 7 aa, Artificial Sequence
  Description of Artificial Sequence: Synthetic peptide
  XENP021905 vlCDR2
AASELES

SEQ ID NO: 39037 - protein, 9 aa, Artificial Sequence
  Description of Artificial Sequence: Synthetic peptide
  XENP021905 vlCDR3
QQSNEDPFT

SEQ ID NO: 39038 - protein, 450 aa, Artificial Sequence; identical to SEQ ID NO: 22424
  Description of Artificial Sequence: Synthetic polypeptide
  XENP021906 7G8_H3.28_L1.13-[CTLA-4]_H3.23_L0.129 Fab-Fc Heavy Chain

SEQ ID NO: 39039 - protein, 121 aa, Artificial Sequence; identical to SEQ ID NO: 22425
  Description of Artificial Sequence: Synthetic polypeptide
  VH of XENP021906

SEQ ID NO: 39040 - protein, 5 aa, Artificial Sequence
  Description of Artificial Sequence: Synthetic peptide
  XENP021906 vhCDR1
DAWMD

SEQ ID NO: 39041 - protein, 19 aa, Artificial Sequence
  Description of Artificial Sequence: Synthetic peptide
  XENP021906 vhCDR2
EISTKAYNHATYYAESVKG

SEQ ID NO: 39042 - protein, 10 aa, Artificial Sequence
  Description of Artificial Sequence: Synthetic peptide
  XENP021906 vhCDR3
LATWDWYFDV

SEQ ID NO: 39043 - protein, 477 aa, Artificial Sequence; identical to SEQ ID NO: 21669
  Description of Artificial Sequence: Synthetic polypeptide
  XENP021906 7G8_H3.28_L1.13-[CTLA-4]_H3.23_L0.129 scFv-Fc Heavy Chain

SEQ ID NO: 39044 - protein, 118 aa, Artificial Sequence; identical to SEQ ID NO: 2632
  Description of Artificial Sequence: Synthetic polypeptide
  VH of XENP021906

SEQ ID NO: 39045 - protein, 108 aa, Artificial Sequence; identical to SEQ ID NO: 2768
  Description of Artificial Sequence: Synthetic polypeptide
  VL of XENP021906

SEQ ID NO: 39046 - protein, 231 aa, Artificial Sequence; identical to SEQ ID NO: 21532
  Description of Artificial Sequence: Synthetic polypeptide
  Fc chain of XENP021906

SEQ ID NO: 39047 - protein, 5 aa, Artificial Sequence
  Description of Artificial Sequence: Synthetic peptide
  XENP021906 vhCDR1
SYTMH

SEQ ID NO: 39048 - protein, 17 aa, Artificial Sequence
  Description of Artificial Sequence: Synthetic peptide
  XENP021906 vhCDR2
FISYDGNYKYYADSVKG

SEQ ID NO: 39049 - protein, 9 aa, Artificial Sequence
  Description of Artificial Sequence: Synthetic peptide
  XENP021906 vhCDR3
GGHLGPFDL

SEQ ID NO: 39050 - protein, 12 aa, Artificial Sequence
  Description of Artificial Sequence: Synthetic peptide
  XENP021906 vlCDR1
RASQSVGSSYLA

SEQ ID NO: 39051 - protein, 7 aa, Artificial Sequence
  Description of Artificial Sequence: Synthetic peptide
  XENP021906 vlCDR2
GASSRAT

SEQ ID NO: 39052 - protein, 9 aa, Artificial Sequence
  Description of Artificial Sequence: Synthetic peptide
  XENP021906 vlCDR3
QQYGSSPWT

SEQ ID NO: 39053 - protein, 218 aa, Artificial Sequence; identical to SEQ ID NO: 22419
  Description of Artificial Sequence: Synthetic polypeptide
  XENP021906 7G8_H3.28_L1.13-[CTLA-4]_H3.23_L0.129 Light Chain

SEQ ID NO: 39054 - protein, 111 aa, Artificial Sequence; identical to SEQ ID NO: 22420
  Description of Artificial Sequence: Synthetic polypeptide
  VL of XENP021906

SEQ ID NO: 39055 - protein, 15 aa, Artificial Sequence
  Description of Artificial Sequence: Synthetic peptide
  XENP021906 vlCDR1
RASQSVDHDGDSYMN

SEQ ID NO: 39056 - protein, 7 aa, Artificial Sequence
  Description of Artificial Sequence: Synthetic peptide
  XENP021906 vlCDR2
AASELES

SEQ ID NO: 39057 - protein, 9 aa, Artificial Sequence
  Description of Artificial Sequence: Synthetic peptide
  XENP021906 vlCDR3
QQSNEDPFT

SEQ ID NO: 39058 - protein, 447 aa, Artificial Sequence; identical to SEQ ID NO: 22064
  Description of Artificial Sequence: Synthetic polypeptide
  XENP022505 2A11_H1.125_L2.113_Fab-[CTLA-4]_H3.23_L0.129 Fab-Fc Heavy Chain

SEQ ID NO: 39059 - protein, 118 aa, Artificial Sequence; identical to SEQ ID NO: 22065
  Description of Artificial Sequence: Synthetic polypeptide
  VH of XENP022505

SEQ ID NO: 39060 - protein, 5 aa, Artificial Sequence
  Description of Artificial Sequence: Synthetic peptide
  XENP022505 vhCDR1
HYFMH

SEQ ID NO: 39061 - protein, 17 aa, Artificial Sequence
  Description of Artificial Sequence: Synthetic peptide
  XENP022505 vhCDR2
WIDPYLGDTEYAPKFQG

SEQ ID NO: 39062 - protein, 9 aa, Artificial Sequence
  Description of Artificial Sequence: Synthetic peptide
  XENP022505 vhCDR3
RGVYQALDY

SEQ ID NO: 39063 - protein, 477 aa, Artificial Sequence; identical to SEQ ID NO: 21669
  Description of Artificial Sequence: Synthetic polypeptide
  XENP022505 2A11_H1.125_L2.113_Fab-[CTLA-4]_H3.23_L0.129 scFv-Fc Heavy Chain

SEQ ID NO: 39064 - protein, 118 aa, Artificial Sequence; identical to SEQ ID NO: 2632
  Description of Artificial Sequence: Synthetic polypeptide
  VH of XENP022505

SEQ ID NO: 39065 - protein, 108 aa, Artificial Sequence; identical to SEQ ID NO: 2768
  Description of Artificial Sequence: Synthetic polypeptide
  VL of XENP022505

SEQ ID NO: 39066 - protein, 231 aa, Artificial Sequence; identical to SEQ ID NO: 21532
  Description of Artificial Sequence: Synthetic polypeptide
  Fc chain of XENP022505

SEQ ID NO: 39067 - protein, 5 aa, Artificial Sequence
  Description of Artificial Sequence: Synthetic peptide
  XENP022505 vhCDR1
SYTMH

SEQ ID NO: 39068 - protein, 17 aa, Artificial Sequence
  Description of Artificial Sequence: Synthetic peptide
  XENP022505 vhCDR2
FISYDGNYKYYADSVKG

SEQ ID NO: 39069 - protein, 9 aa, Artificial Sequence
  Description of Artificial Sequence: Synthetic peptide
  XENP022505 vhCDR3
GGHLGPFDL

SEQ ID NO: 39070 - protein, 12 aa, Artificial Sequence
  Description of Artificial Sequence: Synthetic peptide
  XENP022505 vlCDR1
RASQSVGSSYLA

SEQ ID NO: 39071 - protein, 7 aa, Artificial Sequence
  Description of Artificial Sequence: Synthetic peptide
  XENP022505 vlCDR2
GASSRAT

SEQ ID NO: 39072 - protein, 9 aa, Artificial Sequence
  Description of Artificial Sequence: Synthetic peptide
  XENP022505 vlCDR3
QQYGSSPWT

SEQ ID NO: 39073 - protein, 214 aa, Artificial Sequence; identical to SEQ ID NO: 22079
  Description of Artificial Sequence: Synthetic polypeptide
  XENP022505 2A11_H1.125_L2.113_Fab-[CTLA-4]_H3.23_L0.129 Light Chain

SEQ ID NO: 39074 - protein, 107 aa, Artificial Sequence; identical to SEQ ID NO: 22080
  Description of Artificial Sequence: Synthetic polypeptide
  VL of XENP022505

SEQ ID NO: 39075 - protein, 11 aa, Artificial Sequence
  Description of Artificial Sequence: Synthetic peptide
  XENP022505 vlCDR1
QASQDIGNYLN

SEQ ID NO: 39076 - protein, 7 aa, Artificial Sequence
  Description of Artificial Sequence: Synthetic peptide
  XENP022505 vlCDR2
FTSYLHS

SEQ ID NO: 39077 - protein, 9 aa, Artificial Sequence
  Description of Artificial Sequence: Synthetic peptide
  XENP022505 vlCDR3
QQGNTLPYT

SEQ ID NO: 39078 - protein, 447 aa, Artificial Sequence; identical to SEQ ID NO: 17235
  Description of Artificial Sequence: Synthetic polypeptide
  XENP022510 2A11_H1_L2.25_Fab-[CTLA-4]_H3.23_L0.129 Fab-Fc Heavy Chain

SEQ ID NO: 39079 - protein, 118 aa, Artificial Sequence; identical to SEQ ID NO: 17236
  Description of Artificial Sequence: Synthetic polypeptide
  VH of XENP022510

SEQ ID NO: 39080 - protein, 5 aa, Artificial Sequence
  Description of Artificial Sequence: Synthetic peptide
  XENP022510 vhCDR1
DYYMH

SEQ ID NO: 39081 - protein, 17 aa, Artificial Sequence
  Description of Artificial Sequence: Synthetic peptide
  XENP022510 vhCDR2
WIDPENGDTEYAPKFQG

SEQ ID NO: 39082 - protein, 9 aa, Artificial Sequence
  Description of Artificial Sequence: Synthetic peptide
  XENP022510 vhCDR3
RGVRQALDY

SEQ ID NO: 39083 - protein, 477 aa, Artificial Sequence; identical to SEQ ID NO: 21669
  Description of Artificial Sequence: Synthetic polypeptide
  XENP022510 2A11_H1_L2.25_Fab-[CTLA-4]_H3.23_L0.129 scFv-Fc Heavy Chain

SEQ ID NO: 39084 - protein, 118 aa, Artificial Sequence; identical to SEQ ID NO: 2632
  Description of Artificial Sequence: Synthetic polypeptide
  VH of XENP022510

SEQ ID NO: 39085 - protein, 108 aa, Artificial Sequence; identical to SEQ ID NO: 2768
  Description of Artificial Sequence: Synthetic polypeptide
  VL of XENP022510

SEQ ID NO: 39086 - protein, 231 aa, Artificial Sequence; identical to SEQ ID NO: 21532
  Description of Artificial Sequence: Synthetic polypeptide
  Fc chain of XENP022510

SEQ ID NO: 39087 - protein, 5 aa, Artificial Sequence
  Description of Artificial Sequence: Synthetic peptide
  XENP022510 vhCDR1
SYTMH

SEQ ID NO: 39088 - protein, 17 aa, Artificial Sequence
  Description of Artificial Sequence: Synthetic peptide
  XENP022510 vhCDR2
FISYDGNYKYYADSVKG

SEQ ID NO: 39089 - protein, 9 aa, Artificial Sequence
  Description of Artificial Sequence: Synthetic peptide
  XENP022510 vhCDR3
GGHLGPFDL

SEQ ID NO: 39090 - protein, 12 aa, Artificial Sequence
  Description of Artificial Sequence: Synthetic peptide
  XENP022510 vlCDR1
RASQSVGSSYLA

SEQ ID NO: 39091 - protein, 7 aa, Artificial Sequence
  Description of Artificial Sequence: Synthetic peptide
  XENP022510 vlCDR2
GASSRAT

SEQ ID NO: 39092 - protein, 9 aa, Artificial Sequence
  Description of Artificial Sequence: Synthetic peptide
  XENP022510 vlCDR3
QQYGSSPWT

SEQ ID NO: 39093 - protein, 214 aa, Artificial Sequence; identical to SEQ ID NO: 22179
  Description of Artificial Sequence: Synthetic polypeptide
  XENP022510 2A11_H1_L2.25_Fab-[CTLA-4]_H3.23_L0.129 Light Chain

SEQ ID NO: 39094 - protein, 107 aa, Artificial Sequence; identical to SEQ ID NO: 22180
  Description of Artificial Sequence: Synthetic polypeptide
  VL of XENP022510

SEQ ID NO: 39095 - protein, 11 aa, Artificial Sequence
  Description of Artificial Sequence: Synthetic peptide
  XENP022510 vlCDR1
QASQDIGNHLN

SEQ ID NO: 39096 - protein, 7 aa, Artificial Sequence
  Description of Artificial Sequence: Synthetic peptide
  XENP022510 vlCDR2
YTSRLHS

SEQ ID NO: 39097 - protein, 9 aa, Artificial Sequence
  Description of Artificial Sequence: Synthetic peptide
  XENP022510 vlCDR3
QQGNTLPYT

SEQ ID NO: 39098 - protein, 450 aa, Artificial Sequence; identical to SEQ ID NO: 22484
  Description of Artificial Sequence: Synthetic polypeptide
  XENP022602 7G8_H3.30_L1.34-[CTLA-4]_H3.23_L0.129 Fab-Fc Heavy Chain

SEQ ID NO: 39099 - protein, 121 aa, Artificial Sequence; identical to SEQ ID NO: 22485
  Description of Artificial Sequence: Synthetic polypeptide
  VH of XENP022602

SEQ ID NO: 39100 - protein, 5 aa, Artificial Sequence
  Description of Artificial Sequence: Synthetic peptide
  XENP022602 vhCDR1
DAWMS

SEQ ID NO: 39101 - protein, 19 aa, Artificial Sequence
  Description of Artificial Sequence: Synthetic peptide
  XENP022602 vhCDR2
EISTKANNHATYYAESVKG

SEQ ID NO: 39102 - protein, 10 aa, Artificial Sequence
  Description of Artificial Sequence: Synthetic peptide
  XENP022602 vhCDR3
LATWDWYFDV

SEQ ID NO: 39103 - protein, 477 aa, Artificial Sequence; identical to SEQ ID NO: 21669
  Description of Artificial Sequence: Synthetic polypeptide
  XENP022602 7G8_H3.30_L1.34-[CTLA-4]_H3.23_L0.129 scFv-Fc Heavy Chain

SEQ ID NO: 39104 - protein, 118 aa, Artificial Sequence; identical to SEQ ID NO: 2632
  Description of Artificial Sequence: Synthetic polypeptide
  VH of XENP022602

SEQ ID NO: 39105 - protein, 108 aa, Artificial Sequence; identical to SEQ ID NO: 2768
  Description of Artificial Sequence: Synthetic polypeptide
  VL of XENP022602

SEQ ID NO: 39106 - protein, 231 aa, Artificial Sequence; identical to SEQ ID NO: 21532
  Description of Artificial Sequence: Synthetic polypeptide
  Fc chain of XENP022602

SEQ ID NO: 39107 - protein, 5 aa, Artificial Sequence
  Description of Artificial Sequence: Synthetic peptide
  XENP022602 vhCDR1
SYTMH

SEQ ID NO: 39108 - protein, 17 aa, Artificial Sequence
  Description of Artificial Sequence: Synthetic peptide
  XENP022602 vhCDR2
FISYDGNYKYYADSVKG

SEQ ID NO: 39109 - protein, 9 aa, Artificial Sequence
  Description of Artificial Sequence: Synthetic peptide
  XENP022602 vhCDR3
GGHLGPFDL

SEQ ID NO: 39110 - protein, 12 aa, Artificial Sequence
  Description of Artificial Sequence: Synthetic peptide
  XENP022602 vlCDR1
RASQSVGSSYLA

SEQ ID NO: 39111 - protein, 7 aa, Artificial Sequence
  Description of Artificial Sequence: Synthetic peptide
  XENP022602 vlCDR2
GASSRAT

SEQ ID NO: 39112 - protein, 9 aa, Artificial Sequence
  Description of Artificial Sequence: Synthetic peptide
  XENP022602 vlCDR3
QQYGSSPWT

SEQ ID NO: 39113 - protein, 218 aa, Artificial Sequence; identical to SEQ ID NO: 22599
  Description of Artificial Sequence: Synthetic polypeptide
  XENP022602 7G8_H3.30_L1.34-[CTLA-4]_H3.23_L0.129 Light Chain

SEQ ID NO: 39114 - protein, 111 aa, Artificial Sequence; identical to SEQ ID NO: 22600
  Description of Artificial Sequence: Synthetic polypeptide
  VL of XENP022602

SEQ ID NO: 39115 - protein, 15 aa, Artificial Sequence
  Description of Artificial Sequence: Synthetic peptide
  XENP022602 vlCDR1
RASQSVDYDGDSYMN

SEQ ID NO: 39116 - protein, 7 aa, Artificial Sequence
  Description of Artificial Sequence: Synthetic peptide
  XENP022602 vlCDR2
AASELES

SEQ ID NO: 39117 - protein, 9 aa, Artificial Sequence
  Description of Artificial Sequence: Synthetic peptide
  XENP022602 vlCDR3
QQSNEDPFT

SEQ ID NO: 39118 - protein, 447 aa, Artificial Sequence; identical to SEQ ID NO: 22084
  Description of Artificial Sequence: Synthetic polypeptide
  XENP022675 2A11_H1.144_L2.142_Fab-[CTLA-4]_H3.23_L0.129 Fab-Fc Heavy Chain

SEQ ID NO: 39119 - protein, 118 aa, Artificial Sequence; identical to SEQ ID NO: 22085
  Description of Artificial Sequence: Synthetic polypeptide
  VH of XENP022675

SEQ ID NO: 39120 - protein, 5 aa, Artificial Sequence
  Description of Artificial Sequence: Synthetic peptide
  XENP022675 vhCDR1
DYFMH

SEQ ID NO: 39121 - protein, 17 aa, Artificial Sequence
  Description of Artificial Sequence: Synthetic peptide
  XENP022675 vhCDR2
WIDPELGDTEYAPKFQG

SEQ ID NO: 39122 - protein, 9 aa, Artificial Sequence
  Description of Artificial Sequence: Synthetic peptide
  XENP022675 vhCDR3
RGVYQALDY

SEQ ID NO: 39123 - protein, 477 aa, Artificial Sequence; identical to SEQ ID NO: 21669
  Description of Artificial Sequence: Synthetic polypeptide
  XENP022675 2A11_H1.144_L2.142_Fab-[CTLA-4]_H3.23_L0.129 scFv-Fc Heavy Chain

SEQ ID NO: 39124 - protein, 118 aa, Artificial Sequence; identical to SEQ ID NO: 2632
  Description of Artificial Sequence: Synthetic polypeptide
  VH of XENP022675

SEQ ID NO: 39125 - protein, 108 aa, Artificial Sequence; identical to SEQ ID NO: 2768
  Description of Artificial Sequence: Synthetic polypeptide
  VL of XENP022675

SEQ ID NO: 39126 - protein, 231 aa, Artificial Sequence; identical to SEQ ID NO: 21532
  Description of Artificial Sequence: Synthetic polypeptide
  Fc chain of XENP022675

SEQ ID NO: 39127 - protein, 5 aa, Artificial Sequence
  Description of Artificial Sequence: Synthetic peptide
  XENP022675 vhCDR1
SYTMH

SEQ ID NO: 39128 - protein, 17 aa, Artificial Sequence
  Description of Artificial Sequence: Synthetic peptide
  XENP022675 vhCDR2
FISYDGNYKYYADSVKG

SEQ ID NO: 39129 - protein, 9 aa, Artificial Sequence
  Description of Artificial Sequence: Synthetic peptide
  XENP022675 vhCDR3
GGHLGPFDL

SEQ ID NO: 39130 - protein, 12 aa, Artificial Sequence
  Description of Artificial Sequence: Synthetic peptide
  XENP022675 vlCDR1
RASQSVGSSYLA

SEQ ID NO: 39131 - protein, 7 aa, Artificial Sequence
  Description of Artificial Sequence: Synthetic peptide
  XENP022675 vlCDR2
GASSRAT

SEQ ID NO: 39132 - protein, 9 aa, Artificial Sequence
  Description of Artificial Sequence: Synthetic peptide
  XENP022675 vlCDR3
QQYGSSPWT

SEQ ID NO: 39133 - protein, 214 aa, Artificial Sequence; identical to SEQ ID NO: 22279
  Description of Artificial Sequence: Synthetic polypeptide
  XENP022675 2A11_H1.144_L2.142_Fab-[CTLA-4]_H3.23_L0.129 Light Chain

SEQ ID NO: 39134 - protein, 107 aa, Artificial Sequence; identical to SEQ ID NO: 22280
  Description of Artificial Sequence: Synthetic polypeptide
  VL of XENP022675

SEQ ID NO: 39135 - protein, 11 aa, Artificial Sequence
  Description of Artificial Sequence: Synthetic peptide
  XENP022675 vlCDR1
QASQDIGNYLN

SEQ ID NO: 39136 - protein, 7 aa, Artificial Sequence
  Description of Artificial Sequence: Synthetic peptide
  XENP022675 vlCDR2
FTSYLHS

SEQ ID NO: 39137 - protein, 9 aa, Artificial Sequence
  Description of Artificial Sequence: Synthetic peptide
  XENP022675 vlCDR3
QQGNTLPYT

SEQ ID NO: 39138 - protein, 450 aa, Artificial Sequence; identical to SEQ ID NO: 35607
  Description of Artificial Sequence: Synthetic polypeptide
  XENP022841 7G8_H3.30_L1.34_Fab-[CTLA-4]_H3.23_L0.129_scFv M428L/N434S Fab-Fc Heavy Chain

SEQ ID NO: 39139 - protein, 121 aa, Artificial Sequence; identical to SEQ ID NO: 22485
  Description of Artificial Sequence: Synthetic polypeptide
  VH of XENP022841

SEQ ID NO: 39140 - protein, 5 aa, Artificial Sequence
  Description of Artificial Sequence: Synthetic peptide
  XENP022841 vhCDR1
DAWMS

SEQ ID NO: 39141 - protein, 19 aa, Artificial Sequence
  Description of Artificial Sequence: Synthetic peptide
  XENP022841 vhCDR2
EISTKANNHATYYAESVKG

SEQ ID NO: 39142 - protein, 10 aa, Artificial Sequence
  Description of Artificial Sequence: Synthetic peptide
  XENP022841 vhCDR3
LATWDWYFDV

SEQ ID NO: 39143 - protein, 477 aa, Artificial Sequence; identical to SEQ ID NO: 35612
  Description of Artificial Sequence: Synthetic polypeptide
  XENP022841 7G8_H3.30_L1.34_Fab-[CTLA-4]_H3.23_L0.129_scFv M428L/N434S scFv-Fc Heavy Chain

SEQ ID NO: 39144 - protein, 118 aa, Artificial Sequence; identical to SEQ ID NO: 2632
  Description of Artificial Sequence: Synthetic polypeptide
  VH of XENP022841

SEQ ID NO: 39145 - protein, 108 aa, Artificial Sequence; identical to SEQ ID NO: 2768
  Description of Artificial Sequence: Synthetic polypeptide
  VL of XENP022841

SEQ ID NO: 39146 - protein, 231 aa, Artificial Sequence; identical to SEQ ID NO: 21572
  Description of Artificial Sequence: Synthetic polypeptide
  Fc chain of XENP022841

SEQ ID NO: 39147 - protein, 5 aa, Artificial Sequence
  Description of Artificial Sequence: Synthetic peptide
  XENP022841 vhCDR1
SYTMH

SEQ ID NO: 39148 - protein, 17 aa, Artificial Sequence
  Description of Artificial Sequence: Synthetic peptide
  XENP022841 vhCDR2
FISYDGNYKYYADSVKG

SEQ ID NO: 39149 - protein, 9 aa, Artificial Sequence
  Description of Artificial Sequence: Synthetic peptide
  XENP022841 vhCDR3
GGHLGPFDL

SEQ ID NO: 39150 - protein, 12 aa, Artificial Sequence
  Description of Artificial Sequence: Synthetic peptide
  XENP022841 vlCDR1
RASQSVGSSYLA

SEQ ID NO: 39151 - protein, 7 aa, Artificial Sequence
  Description of Artificial Sequence: Synthetic peptide
  XENP022841 vlCDR2
GASSRAT

SEQ ID NO: 39152 - protein, 9 aa, Artificial Sequence
  Description of Artificial Sequence: Synthetic peptide
  XENP022841 vlCDR3
QQYGSSPWT

SEQ ID NO: 39153 - protein, 218 aa, Artificial Sequence; identical to SEQ ID NO: 22599
  Description of Artificial Sequence: Synthetic polypeptide
  XENP022841 7G8_H3.30_L1.34_Fab-[CTLA-4]_H3.23_L0.129_scFv M428L/N434S Light Chain

SEQ ID NO: 39154 - protein, 111 aa, Artificial Sequence; identical to SEQ ID NO: 22600
  Description of Artificial Sequence: Synthetic polypeptide
  VL of XENP022841

SEQ ID NO: 39155 - protein, 15 aa, Artificial Sequence
  Description of Artificial Sequence: Synthetic peptide
  XENP022841 vlCDR1
RASQSVDYDGDSYMN

SEQ ID NO: 39156 - protein, 7 aa, Artificial Sequence
  Description of Artificial Sequence: Synthetic peptide
  XENP022841 vlCDR2
AASELES

SEQ ID NO: 39157 - protein, 9 aa, Artificial Sequence
  Description of Artificial Sequence: Synthetic peptide
  XENP022841 vlCDR3
QQSNEDPFT

SEQ ID NO: 39158 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39159 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39160 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39161 - protein, 231 aa, Artificial Sequence; identical to SEQ ID NO: 39159
  Description of Artificial Sequence: Synthetic polypeptide

SEQ ID NO: 39162 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 39163 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39164 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSLSLSLGK

SEQ ID NO: 39165 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 39166 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39167 - protein, 228 aa, Artificial Sequence
  Description of Artificial Sequence: Synthetic polypeptide
ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39168 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39169 - protein, 228 aa, Artificial Sequence
  Description of Artificial Sequence: Synthetic polypeptide
ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39170 - protein, 329 aa, Artificial Sequence; identical to SEQ ID NO: 37725
  Description of Artificial Sequence: Synthetic polypeptide

SEQ ID NO: 39171 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39172 - protein, 329 aa, Artificial Sequence; identical to SEQ ID NO: 39160
  Description of Artificial Sequence: Synthetic polypeptide

SEQ ID NO: 39173 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39174 - protein, 329 aa, Artificial Sequence; identical to SEQ ID NO: 39162
  Description of Artificial Sequence: Synthetic polypeptide

SEQ ID NO: 39175 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39176 - protein, 327 aa, Artificial Sequence; identical to SEQ ID NO: 39164
  Description of Artificial Sequence: Synthetic polypeptide

SEQ ID NO: 39177 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 39178 - protein, 326 aa, Artificial Sequence; identical to SEQ ID NO: 39166
  Description of Artificial Sequence: Synthetic polypeptide

SEQ ID NO: 39179 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39180 - protein, 326 aa, Artificial Sequence; identical to SEQ ID NO: 39168
  Description of Artificial Sequence: Synthetic polypeptide

SEQ ID NO: 39181 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK
